United States Patent 11,931,400 (THERAPEUTIC AND DIAGNOSTICS COMPOSITIONS TARGETING TOLL-LIKE RECEPTORS AND METHODS THEREOF) - sequence listing, part 2

SEQ ID NO: 35971 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Glu, Gly, Trp or Phe
  MISC_FEATURE (43)..(43): Xaa = Gly, Ala or Asn
  MISC_FEATURE (46)..(46): Xaa = His, Trp or Lys
  MISC_FEATURE (51)..(52): Xaa = any amino acid, non amino acid, or is absent
XXXAXXAPXIXXXXNSXXNXLAXCXLSXXIXVXXXQLXIXHXXQPXAQEPXX

SEQ ID NO: 35972 - protein, 51 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (45)..(45): Xaa = any amino acid, non amino acid, or is absent
  MISC_FEATURE (48)..(51): Xaa = any amino acid, non amino acid, or is absent
XXHXXQPXAQEPXXNSXXNXLAXCXLSXXIXVXXXQLXIXXXGFXLKXXXX

SEQ ID NO: 35973 - protein, 52 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (46)..(46): Xaa = Asn or Asp
  MISC_FEATURE (47)..(47): Xaa = Asn or Glu
  MISC_FEATURE (48)..(52): Xaa = any amino acid, non amino acid, or is absent
XXHXXQPXAQEPXXNSXXNXLAXCXLSXXIXVXXXQLXIXXXTPAXXXXXXX

SEQ ID NO: 35974 - protein, 48 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Ile, Phe, Trp, Tyr or Ala
  MISC_FEATURE (42)..(42): Xaa = Asp, Ala, Gln, Glu, Gly, His, Ile, Leu, Phe, Pro, Thr or Tyr
  MISC_FEATURE (43)..(43): Xaa = Gln, Leu, Trp or Tyr
  MISC_FEATURE (47)..(48): Xaa = any amino acid, non amino acid, or is absent
XXHXXQPXAQEPXXNSXXNXLAXCXLSXXIXVXXXQLXIXXXXAPWXX

SEQ ID NO: 35975 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (43)..(43): Xaa = Tyr or Pro
  MISC_FEATURE (44)..(44): Xaa = Trp, Tyr, Phe, Ala, Val, Cys, Thr, Leu, Ser, His, Gln, Glu, Gly or Ile
  MISC_FEATURE (45)..(45): Xaa = Trp, Ile, Phe, Pro, Asp, Gly, Cys or Ala
  MISC_FEATURE (46)..(46): Xaa = Gly or Asn
  MISC_FEATURE (48)..(49): Xaa = any amino acid, non amino acid, or is absent
XXHXXQPXAQEPXXNSXXNXLAXCXLSXXIXVXXXQLXIXPPXXXXPXX

SEQ ID NO: 35976 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Gly, Tyr or Trp
  MISC_FEATURE (42)..(42): Xaa = Trp, Val, Ile, Phe, Arg, Met, Ser or Leu
  MISC_FEATURE (43)..(43): Xaa = Ile or Gly
  MISC_FEATURE (44)..(44): Xaa = Tyr, Pro, His, Leu or Phe
  MISC_FEATURE (45)..(45): Xaa = Ile, Asp, Tyr, Phe, Val, Thr, Gly, Ala or Gln
  MISC_FEATURE (46)..(46): Xaa = Phe, Arg, Cys, Leu, Ala, Gln, Asp or Val
  MISC_FEATURE (47)..(47): Xaa = Phe or Tyr
  MISC_FEATURE (48)..(49): Xaa = any amino acid, non amino acid, or is absent
XXHXXQPXAQEPXXNSXXNXLAXCXLSXXIXVXXXQLXIXXXXXXXXXX

SEQ ID NO: 35977 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Pro or Ser
  MISC_FEATURE (47)..(47): Xaa = Pro, Tyr, Leu, Ala, Glu, Gly, Val or Ile
  MISC_FEATURE (48)..(49): Xaa = any amino acid, non amino acid, or is absent
XXHXXQPXAQEPXXNSXXNXLAXCXLSXXIXVXXXQLXIXFXPPAPXXX

SEQ ID NO: 35978 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (44)..(44): Xaa = Val or Ile
  MISC_FEATURE (48)..(49): Xaa = any amino acid, non amino acid, or is absent
XXHXXQPXAQEPXXNSXXNXLAXCXLSXXIXVXXXQLXIXDFTXFPPXX

SEQ ID NO: 35979 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Tyr, Thr or His
  MISC_FEATURE (45)..(45): Xaa = His or Ile
  MISC_FEATURE (47)..(47): Xaa = Tyr or Ala
  MISC_FEATURE (48)..(49): Xaa = any amino acid, non amino acid, or is absent
XXHXXQPXAQEPXXNSXXNXLAXCXLSXXIXVXXXQLXIXXTPAXFXXX

SEQ ID NO: 35980 - protein, 52 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Pro or Ala
  MISC_FEATURE (44)..(44): Xaa = Ala, Pro, Trp, Asn or Leu
  MISC_FEATURE (47)..(47): Xaa = Pro or Phe
  MISC_FEATURE (51)..(52): Xaa = any amino acid, non amino acid, or is absent
XXHXXQPXAQEPXXNSXXNXLAXCXLSXXIXVXXXQLXIXXARXTPXSPPXX

SEQ ID NO: 35981 - protein, 50 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Trp or Leu
  MISC_FEATURE (42)..(42): Xaa = Ala, Asn, Ser, Trp or Glu
  MISC_FEATURE (48)..(48): Xaa = Ser or Phe
  MISC_FEATURE (49)..(50): Xaa = any amino acid, non amino acid, or is absent
XXHXXQPXAQEPXXNSXXNXLAXCXLSXXIXVXXXQLXIXXXTAYKPXXX

SEQ ID NO: 35982 - protein, 52 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Asn, Trp or Ala
  MISC_FEATURE (43)..(43): Xaa = Phe, Asn, Tyr or Pro
  MISC_FEATURE (44)..(44): Xaa = Pro, His, Tyr, Trp or Ala
  MISC_FEATURE (47)..(47): Xaa = Tyr or Ala
  MISC_FEATURE (49)..(49): Xaa = Trp or Gln
  MISC_FEATURE (50)..(50): Xaa = Arg or Gln
  MISC_FEATURE (51)..(52): Xaa = any amino acid, non amino acid, or is absent
XXHXXQPXAQEPXXNSXXNXLAXCXLSXXIXVXXXQLXIXXAXXAPXIXXXX

SEQ ID NO: 35983 - protein, 52 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Glu, Gly, Trp or Phe
  MISC_FEATURE (43)..(43): Xaa = Gly, Ala or Asn
  MISC_FEATURE (46)..(46): Xaa = His, Trp or Lys
  MISC_FEATURE (51)..(52): Xaa = any amino acid, non amino acid, or is absent
XXHXXQPXAQEPXXNSXXNXLAXCXLSXXIXVXXXQLXIXHXXQPXAQEPXX

SEQ ID NO: 35984 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXXGFXLKXXXXXGFXLKXXXXXGFXLKXXXX

SEQ ID NO: 35985 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXXGFXLKXXXXXGFXLKXXXXXTPAXXXXXXX

SEQ ID NO: 35986 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXXGFXLKXXXXXGFXLKXXXXXXAPWXX

SEQ ID NO: 35987 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXXGFXLKXXXXXGFXLKXXXPPXXXXPXX

SEQ ID NO: 35988 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXXGFXLKXXXXXGFXLKXXXXXXXXXXXX

SEQ ID NO: 35989 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXXGFXLKXXXXXGFXLKXXXFXPPAPXXX

SEQ ID NO: 35990 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXXGFXLKXXXXXGFXLKXXXDFTXFPPXX

SEQ ID NO: 35991 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXXGFXLKXXXXXGFXLKXXXXTPAXFXXX

SEQ ID NO: 35992 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXXGFXLKXXXXXGFXLKXXXXARXTPXSPPXX

SEQ ID NO: 35993 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXXGFXLKXXXXXGFXLKXXXXXTAYKPXXX

SEQ ID NO: 35994 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXXGFXLKXXXXXGFXLKXXXXAXXAPXIXXXX

SEQ ID NO: 35995 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (17)..(17): Xaa = any amino acid, non amino acid, or is absent
  MISC_FEATURE (20)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXXGFXLKXXXXXGFXLKXXXHXXQPXAQEPXX

SEQ ID NO: 35996 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXXXGFXLKXXXXXTPAXXXXXXXXGFXLKXXXX

SEQ ID NO: 35997 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXXXGFXLKXXXXXTPAXXXXXXXXTPAXXXXXXX

SEQ ID NO: 35998 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXXXGFXLKXXXXXTPAXXXXXXXXXAPWXX

SEQ ID NO: 35999 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXXXGFXLKXXXXXTPAXXXXXXPPXXXXPXX

SEQ ID NO: 36000 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXXXGFXLKXXXXXTPAXXXXXXXXXXXXXXX

SEQ ID NO: 36001 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXXXGFXLKXXXXXTPAXXXXXXFXPPAPXXX

SEQ ID NO: 36002 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXXXGFXLKXXXXXTPAXXXXXXDFTXFPPXX

SEQ ID NO: 36003 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXXXGFXLKXXXXXTPAXXXXXXXTPAXFXXX

SEQ ID NO: 36004 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXXXGFXLKXXXXXTPAXXXXXXXARXTPXSPPXX

SEQ ID NO: 36005 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXXXGFXLKXXXXXTPAXXXXXXXXTAYKPXXX

SEQ ID NO: 36006 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXXXGFXLKXXXXXTPAXXXXXXXAXXAPXIXXXX

SEQ ID NO: 36007 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(14): Xaa = any amino acid, non amino acid, or is absent
  MISC_FEATURE (18)..(18): Xaa = Asn or Asp
  MISC_FEATURE (19)..(19): Xaa = Asn or Glu
  MISC_FEATURE (20)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXXXGFXLKXXXXXTPAXXXXXXHXXQPXAQEPXX

SEQ ID NO: 36008 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXGFXLKXXXXXXAPWXXXGFXLKXXXX

SEQ ID NO: 36009 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXGFXLKXXXXXXAPWXXXTPAXXXXXXX

SEQ ID NO: 36010 - protein, 27 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXGFXLKXXXXXXAPWXXXXAPWXX

SEQ ID NO: 36011 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXGFXLKXXXXXXAPWXPPXXXXPXX

SEQ ID NO: 36012 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXGFXLKXXXXXXAPWXXXXXXXXXX

SEQ ID NO: 36013 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXGFXLKXXXXXXAPWXFXPPAPXXX

SEQ ID NO: 36014 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXGFXLKXXXXXXAPWXDFTXFPPXX

SEQ ID NO: 36015 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXGFXLKXXXXXXAPWXXTPAXFXXX

SEQ ID NO: 36016 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXGFXLKXXXXXXAPWXXARXTPXSPPXX

SEQ ID NO: 36017 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXGFXLKXXXXXXAPWXXXTAYKPXXX

SEQ ID NO: 36018 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXGFXLKXXXXXXAPWXXAXXAPXIXXXX

SEQ ID NO: 36019 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Ile, Phe, Trp, Tyr or Ala
  MISC_FEATURE (14)..(14): Xaa = Asp, Ala, Gln, Glu, Gly, His, Ile, Leu, Phe, Pro, Thr or Tyr
  MISC_FEATURE (15)..(15): Xaa = Gln, Leu, Trp or Tyr
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXGFXLKXXXXXXAPWXHXXQPXAQEPXX

SEQ ID NO: 36020 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXGFXLKXXXPPXXXXPXXXGFXLKXXXX

SEQ ID NO: 36021 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXGFXLKXXXPPXXXXPXXXTPAXXXXXXX

SEQ ID NO: 36022 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXGFXLKXXXPPXXXXPXXXXAPWXX

SEQ ID NO: 36023 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXGFXLKXXXPPXXXXPXPPXXXXPXX

SEQ ID NO: 36024 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXGFXLKXXXPPXXXXPXXXXXXXXXX

SEQ ID NO: 36025 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXGFXLKXXXPPXXXXPXFXPPAPXXX

SEQ ID NO: 36026 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXGFXLKXXXPPXXXXPXDFTXFPPXX

SEQ ID NO: 36027 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXGFXLKXXXPPXXXXPXXTPAXFXXX

SEQ ID NO: 36028 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXGFXLKXXXPPXXXXPXXARXTPXSPPXX

SEQ ID NO: 36029 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXGFXLKXXXPPXXXXPXXXTAYKPXXX

SEQ ID NO: 36030 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXGFXLKXXXPPXXXXPXXAXXAPXIXXXX

SEQ ID NO: 36031 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (15)..(15): Xaa = Tyr or Pro
  MISC_FEATURE (16)..(16): Xaa = Trp, Tyr, Phe, Ala, Val, Cys, Thr, Leu, Ser, His, Gln, Glu, Gly or Ile
  MISC_FEATURE (17)..(17): Xaa = Trp, Ile, Phe, Pro, Asp, Gly, Cys or Ala
  MISC_FEATURE (18)..(18): Xaa = Gly or Asn
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXGFXLKXXXPPXXXXPXHXXQPXAQEPXX

SEQ ID NO: 36032 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXGFXLKXXXXXXXXXXXXXGFXLKXXXX

SEQ ID NO: 36033 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXGFXLKXXXXXXXXXXXXXTPAXXXXXXX

SEQ ID NO: 36034 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXGFXLKXXXXXXXXXXXXXXAPWXX

SEQ ID NO: 36035 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXGFXLKXXXXXXXXXXXPPXXXXPXX

SEQ ID NO: 36036 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXGFXLKXXXXXXXXXXXXXXXXXXXX

SEQ ID NO: 36037 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXGFXLKXXXXXXXXXXXFXPPAPXXX

SEQ ID NO: 36038 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXGFXLKXXXXXXXXXXXDFTXFPPXX

SEQ ID NO: 36039 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXGFXLKXXXXXXXXXXXXTPAXFXXX

SEQ ID NO: 36040 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXGFXLKXXXXXXXXXXXXARXTPXSPPXX

SEQ ID NO: 36041 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXGFXLKXXXXXXXXXXXXXTAYKPXXX

SEQ ID NO: 36042 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXGFXLKXXXXXXXXXXXXAXXAPXIXXXX

SEQ ID NO: 36043 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Gly, Tyr or Trp
  MISC_FEATURE (14)..(14): Xaa = Trp, Val, Ile, Phe, Arg, Met, Ser or Leu
  MISC_FEATURE (15)..(15): Xaa = Ile or Gly
  MISC_FEATURE (16)..(16): Xaa = Tyr, Pro, His, Leu or Phe
  MISC_FEATURE (17)..(17): Xaa = Ile, Asp, Tyr, Phe, Val, Thr, Gly, Ala or Gln
  MISC_FEATURE (18)..(18): Xaa = Phe, Arg, Cys, Leu, Ala, Gln, Asp or Val
  MISC_FEATURE (19)..(19): Xaa = Phe or Tyr
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXGFXLKXXXXXXXXXXXHXXQPXAQEPXX

SEQ ID NO: 36044 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXGFXLKXXXFXPPAPXXXXGFXLKXXXX

SEQ ID NO: 36045 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXGFXLKXXXFXPPAPXXXXTPAXXXXXXX

SEQ ID NO: 36046 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXGFXLKXXXFXPPAPXXXXXAPWXX

SEQ ID NO: 36047 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXGFXLKXXXFXPPAPXXPPXXXXPXX

SEQ ID NO: 36048 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXGFXLKXXXFXPPAPXXXXXXXXXXX

SEQ ID NO: 36049 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXGFXLKXXXFXPPAPXXFXPPAPXXX

SEQ ID NO: 36050 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXGFXLKXXXFXPPAPXXDFTXFPPXX

SEQ ID NO: 36051 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXGFXLKXXXFXPPAPXXXTPAXFXXX

SEQ ID NO: 36052 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXGFXLKXXXFXPPAPXXXARXTPXSPPXX

SEQ ID NO: 36053 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXGFXLKXXXFXPPAPXXXXTAYKPXXX

SEQ ID NO: 36054 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXGFXLKXXXFXPPAPXXXAXXAPXIXXXX

SEQ ID NO: 36055 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Pro or Ser
  MISC_FEATURE (19)..(19): Xaa = Pro, Tyr, Leu, Ala, Glu, Gly, Val or Ile
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXGFXLKXXXFXPPAPXXHXXQPXAQEPXX

SEQ ID NO: 36056 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXGFXLKXXXDFTXFPPXXXGFXLKXXXX

SEQ ID NO: 36057 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXGFXLKXXXDFTXFPPXXXTPAXXXXXXX

SEQ ID NO: 36058 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXGFXLKXXXDFTXFPPXXXXAPWXX

SEQ ID NO: 36059 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXGFXLKXXXDFTXFPPXPPXXXXPXX

SEQ ID NO: 36060 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXGFXLKXXXDFTXFPPXXXXXXXXXX

SEQ ID NO: 36061 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXGFXLKXXXDFTXFPPXFXPPAPXXX

SEQ ID NO: 36062 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXGFXLKXXXDFTXFPPXDFTXFPPXX

SEQ ID NO: 36063 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXGFXLKXXXDFTXFPPXXTPAXFXXX

SEQ ID NO: 36064 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXGFXLKXXXDFTXFPPXXARXTPXSPPXX

SEQ ID NO: 36065 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXGFXLKXXXDFTXFPPXXXTAYKPXXX

SEQ ID NO: 36066 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXGFXLKXXXDFTXFPPXXAXXAPXIXXXX

SEQ ID NO: 36067 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (16)..(16): Xaa = Val or Ile
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXGFXLKXXXDFTXFPPXHXXQPXAQEPXX

SEQ ID NO: 36068 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXGFXLKXXXXTPAXFXXXXGFXLKXXXX

SEQ ID NO: 36069 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXGFXLKXXXXTPAXFXXXXTPAXXXXXXX

SEQ ID NO: 36070 - protein, 28 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXGFXLKXXXXTPAXFXXXXXAPWXX

SEQ ID NO: 36071 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXGFXLKXXXXTPAXFXXPPXXXXPXX

SEQ ID NO: 36072 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXGFXLKXXXXTPAXFXXXXXXXXXXX

SEQ ID NO: 36073 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXGFXLKXXXXTPAXFXXFXPPAPXXX

SEQ ID NO: 36074 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXGFXLKXXXXTPAXFXXDFTXFPPXX

SEQ ID NO: 36075 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXGFXLKXXXXTPAXFXXXTPAXFXXX

SEQ ID NO: 36076 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXGFXLKXXXXTPAXFXXXARXTPXSPPXX

SEQ ID NO: 36077 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXGFXLKXXXXTPAXFXXXXTAYKPXXX

SEQ ID NO: 36078 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXGFXLKXXXXTPAXFXXXAXXAPXIXXXX

SEQ ID NO: 36079 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Tyr, Thr or His
  MISC_FEATURE (17)..(17): Xaa = His or Ile
  MISC_FEATURE (19)..(19): Xaa = Tyr or Ala
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXGFXLKXXXXTPAXFXXHXXQPXAQEPXX

SEQ ID NO: 36080 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXXXGFXLKXXXXARXTPXSPPXXXGFXLKXXXX

SEQ ID NO: 36081 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXXXGFXLKXXXXARXTPXSPPXXXTPAXXXXXXX

SEQ ID NO: 36082 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXXXGFXLKXXXXARXTPXSPPXXXXAPWXX

SEQ ID NO: 36083 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXXXGFXLKXXXXARXTPXSPPXPPXXXXPXX

SEQ ID NO: 36084 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXXXGFXLKXXXXARXTPXSPPXXXXXXXXXX

SEQ ID NO: 36085 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXXXGFXLKXXXXARXTPXSPPXFXPPAPXXX

SEQ ID NO: 36086 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXXXGFXLKXXXXARXTPXSPPXDFTXFPPXX

SEQ ID NO: 36087 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXXXGFXLKXXXXARXTPXSPPXXTPAXFXXX

SEQ ID NO: 36088 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXXXGFXLKXXXXARXTPXSPPXXARXTPXSPPXX

SEQ ID NO: 36089 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXXXGFXLKXXXXARXTPXSPPXXXTAYKPXXX

SEQ ID NO: 36090 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXXXGFXLKXXXXARXTPXSPPXXAXXAPXIXXXX

SEQ ID NO: 36091 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Pro or Ala
  MISC_FEATURE (16)..(16): Xaa = Ala, Pro, Trp, Asn or Leu
  MISC_FEATURE (19)..(19): Xaa = Pro or Phe
  MISC_FEATURE (23)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXXXGFXLKXXXXARXTPXSPPXHXXQPXAQEPXX

SEQ ID NO: 36092 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXGFXLKXXXXXTAYKPXXXXGFXLKXXXX

SEQ ID NO: 36093 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXGFXLKXXXXXTAYKPXXXXTPAXXXXXXX

SEQ ID NO: 36094 - protein, 29 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXGFXLKXXXXXTAYKPXXXXXAPWXX

SEQ ID NO: 36095 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXGFXLKXXXXXTAYKPXXPPXXXXPXX

SEQ ID NO: 36096 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXGFXLKXXXXXTAYKPXXXXXXXXXXX

SEQ ID NO: 36097 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXGFXLKXXXXXTAYKPXXFXPPAPXXX

SEQ ID NO: 36098 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXGFXLKXXXXXTAYKPXXDFTXFPPXX

SEQ ID NO: 36099 - protein, 30 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXGFXLKXXXXXTAYKPXXXTPAXFXXX

SEQ ID NO: 36100 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXGFXLKXXXXXTAYKPXXXARXTPXSPPXX

SEQ ID NO: 36101 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXGFXLKXXXXXTAYKPXXXXTAYKPXXX

SEQ ID NO: 36102 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXGFXLKXXXXXTAYKPXXXAXXAPXIXXXX

SEQ ID NO: 36103 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Trp or Leu
  MISC_FEATURE (14)..(14): Xaa = Ala, Asn, Ser, Trp or Glu
  MISC_FEATURE (20)..(20): Xaa = Ser or Phe
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXGFXLKXXXXXTAYKPXXHXXQPXAQEPXX

SEQ ID NO: 36104 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXXXGFXLKXXXXAXXAPXIXXXXXGFXLKXXXX

SEQ ID NO: 36105 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXXXGFXLKXXXXAXXAPXIXXXXXTPAXXXXXXX

SEQ ID NO: 36106 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXXXGFXLKXXXXAXXAPXIXXXXXXAPWXX

SEQ ID NO: 36107 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXXXGFXLKXXXXAXXAPXIXXXPPXXXXPXX

SEQ ID NO: 36108 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXXXGFXLKXXXXAXXAPXIXXXXXXXXXXXX

SEQ ID NO: 36109 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXXXGFXLKXXXXAXXAPXIXXXFXPPAPXXX

SEQ ID NO: 36110 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXXXGFXLKXXXXAXXAPXIXXXDFTXFPPXX

SEQ ID NO: 36111 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXXXGFXLKXXXXAXXAPXIXXXXTPAXFXXX

SEQ ID NO: 36112 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXXXGFXLKXXXXAXXAPXIXXXXARXTPXSPPXX

SEQ ID NO: 36113 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXXXGFXLKXXXXAXXAPXIXXXXXTAYKPXXX

SEQ ID NO: 36114 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXXXGFXLKXXXXAXXAPXIXXXXAXXAPXIXXXX

SEQ ID NO: 36115 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (13)..(13): Xaa = Asn, Trp or Ala
  MISC_FEATURE (15)..(15): Xaa = Phe, Asn, Tyr or Pro
  MISC_FEATURE (16)..(16): Xaa = Pro, His, Tyr, Trp or Ala
  MISC_FEATURE (19)..(19): Xaa = Tyr or Ala
  MISC_FEATURE (21)..(21): Xaa = Trp or Gln
  MISC_FEATURE (22)..(22): Xaa = Arg or Gln
  MISC_FEATURE (23)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXXXGFXLKXXXXAXXAPXIXXXHXXQPXAQEPXX

SEQ ID NO: 36116 - protein, 34 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXXXGFXLKXXXHXXQPXAQEPXXXGFXLKXXXX

SEQ ID NO: 36117 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXXXGFXLKXXXHXXQPXAQEPXXXTPAXXXXXXX

SEQ ID NO: 36118 - protein, 31 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXXXGFXLKXXXHXXQPXAQEPXXXXAPWXX

SEQ ID NO: 36119 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXXXGFXLKXXXHXXQPXAQEPXPPXXXXPXX

SEQ ID NO: 36120 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXXXGFXLKXXXHXXQPXAQEPXXXXXXXXXX

SEQ ID NO: 36121 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXXXGFXLKXXXHXXQPXAQEPXFXPPAPXXX

SEQ ID NO: 36122 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXXXGFXLKXXXHXXQPXAQEPXDFTXFPPXX

SEQ ID NO: 36123 - protein, 32 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXXXGFXLKXXXHXXQPXAQEPXXTPAXFXXX

SEQ ID NO: 36124 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXXXGFXLKXXXHXXQPXAQEPXXARXTPXSPPXX

SEQ ID NO: 36125 - protein, 33 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXXXGFXLKXXXHXXQPXAQEPXXXTAYKPXXX

SEQ ID NO: 36126 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXXXGFXLKXXXHXXQPXAQEPXXAXXAPXIXXXX

SEQ ID NO: 36127 - protein, 35 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(12): Xaa = any amino acid, non amino acid, or is absent
  MISC_FEATURE (14)..(14): Xaa = Glu, Gly, Trp or Phe
  MISC_FEATURE (15)..(15): Xaa = Gly, Ala or Asn
  MISC_FEATURE (18)..(18): Xaa = His, Trp or Lys
  MISC_FEATURE (23)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXXXGFXLKXXXHXXQPXAQEPXHXXQPXAQEPXX

SEQ ID NO: 36128 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXXXTPAXXXXXXXXGFXLKXXXXXGFXLKXXXX

SEQ ID NO: 36129 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXXXTPAXXXXXXXXGFXLKXXXXXTPAXXXXXXX

SEQ ID NO: 36130 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXXXTPAXXXXXXXXGFXLKXXXXXXAPWXX

SEQ ID NO: 36131 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXXXTPAXXXXXXXXGFXLKXXXPPXXXXPXX

SEQ ID NO: 36132 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXXXTPAXXXXXXXXGFXLKXXXXXXXXXXXX

SEQ ID NO: 36133 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXXXTPAXXXXXXXXGFXLKXXXFXPPAPXXX

SEQ ID NO: 36134 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXXXTPAXXXXXXXXGFXLKXXXDFTXFPPXX

SEQ ID NO: 36135 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXXXTPAXXXXXXXXGFXLKXXXXTPAXFXXX

SEQ ID NO: 36136 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXXXTPAXXXXXXXXGFXLKXXXXARXTPXSPPXX

SEQ ID NO: 36137 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXXXTPAXXXXXXXXGFXLKXXXXXTAYKPXXX

SEQ ID NO: 36138 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXXXTPAXXXXXXXXGFXLKXXXXAXXAPXIXXXX

SEQ ID NO: 36139 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXXXTPAXXXXXXXXGFXLKXXXHXXQPXAQEPXX

SEQ ID NO: 36140 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXXTPAXXXXXXXXTPAXXXXXXXXGFXLKXXXX

SEQ ID NO: 36141 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXXTPAXXXXXXXXTPAXXXXXXXXTPAXXXXXXX

SEQ ID NO: 36142 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXXTPAXXXXXXXXTPAXXXXXXXXXAPWXX

SEQ ID NO: 36143 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXXTPAXXXXXXXXTPAXXXXXXPPXXXXPXX

SEQ ID NO: 36144 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXXTPAXXXXXXXXTPAXXXXXXXXXXXXXXX

SEQ ID NO: 36145 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXXTPAXXXXXXXXTPAXXXXXXFXPPAPXXX

SEQ ID NO: 36146 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXXTPAXXXXXXXXTPAXXXXXXDFTXFPPXX

SEQ ID NO: 36147 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXXTPAXXXXXXXXTPAXXXXXXXTPAXFXXX

SEQ ID NO: 36148 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXXTPAXXXXXXXXTPAXXXXXXXARXTPXSPPXX

SEQ ID NO: 36149 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXXTPAXXXXXXXXTPAXXXXXXXXTAYKPXXX

SEQ ID NO: 36150 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXXTPAXXXXXXXXTPAXXXXXXXAXXAPXIXXXX

SEQ ID NO: 36151 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXXTPAXXXXXXXXTPAXXXXXXHXXQPXAQEPXX

SEQ ID NO: 36152 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXTPAXXXXXXXXXAPWXXXGFXLKXXXX

SEQ ID NO: 36153 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXTPAXXXXXXXXXAPWXXXTPAXXXXXXX

SEQ ID NO: 36154 - protein, 28 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXTPAXXXXXXXXXAPWXXXXAPWXX

SEQ ID NO: 36155 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXTPAXXXXXXXXXAPWXPPXXXXPXX

SEQ ID NO: 36156 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXTPAXXXXXXXXXAPWXXXXXXXXXX

SEQ ID NO: 36157 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXTPAXXXXXXXXXAPWXFXPPAPXXX

SEQ ID NO: 36158 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXTPAXXXXXXXXXAPWXDFTXFPPXX

SEQ ID NO: 36159 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXTPAXXXXXXXXXAPWXXTPAXFXXX

SEQ ID NO: 36160 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXTPAXXXXXXXXXAPWXXARXTPXSPPXX

SEQ ID NO: 36161 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXTPAXXXXXXXXXAPWXXXTAYKPXXX

SEQ ID NO: 36162 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXTPAXXXXXXXXXAPWXXAXXAPXIXXXX

SEQ ID NO: 36163 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXTPAXXXXXXXXXAPWXHXXQPXAQEPXX

SEQ ID NO: 36164 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXTPAXXXXXXPPXXXXPXXXGFXLKXXXX

SEQ ID NO: 36165 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXTPAXXXXXXPPXXXXPXXXTPAXXXXXXX

SEQ ID NO: 36166 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXTPAXXXXXXPPXXXXPXXXXAPWXX

SEQ ID NO: 36167 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXTPAXXXXXXPPXXXXPXPPXXXXPXX

SEQ ID NO: 36168 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXTPAXXXXXXPPXXXXPXXXXXXXXXX

SEQ ID NO: 36169 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXTPAXXXXXXPPXXXXPXFXPPAPXXX

SEQ ID NO: 36170 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXTPAXXXXXXPPXXXXPXDFTXFPPXX

SEQ ID NO: 36171 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXTPAXXXXXXPPXXXXPXXTPAXFXXX

SEQ ID NO: 36172 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXTPAXXXXXXPPXXXXPXXARXTPXSPPXX

SEQ ID NO: 36173 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXTPAXXXXXXPPXXXXPXXXTAYKPXXX

SEQ ID NO: 36174 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXTPAXXXXXXPPXXXXPXXAXXAPXIXXXX

SEQ ID NO: 36175 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXTPAXXXXXXPPXXXXPXHXXQPXAQEPXX

SEQ ID NO: 36176 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXTPAXXXXXXXXXXXXXXXXGFXLKXXXX

SEQ ID NO: 36177 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXTPAXXXXXXXXXXXXXXXXTPAXXXXXXX

SEQ ID NO: 36178 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXTPAXXXXXXXXXXXXXXXXXAPWXX

SEQ ID NO: 36179 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXTPAXXXXXXXXXXXXXXPPXXXXPXX

SEQ ID NO: 36180 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXTPAXXXXXXXXXXXXXXXXXXXXXXX

SEQ ID NO: 36181 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXTPAXXXXXXXXXXXXXXFXPPAPXXX

SEQ ID NO: 36182 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXTPAXXXXXXXXXXXXXXDFTXFPPXX

SEQ ID NO: 36183 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXTPAXXXXXXXXXXXXXXXTPAXFXXX

SEQ ID NO: 36184 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXTPAXXXXXXXXXXXXXXXARXTPXSPPXX

SEQ ID NO: 36185 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXTPAXXXXXXXXXXXXXXXXTAYKPXXX

SEQ ID NO: 36186 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXTPAXXXXXXXXXXXXXXXAXXAPXIXXXX

SEQ ID NO: 36187 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXTPAXXXXXXXXXXXXXXHXXQPXAQEPXX

SEQ ID NO: 36188 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXTPAXXXXXXFXPPAPXXXXGFXLKXXXX

SEQ ID NO: 36189 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXTPAXXXXXXFXPPAPXXXXTPAXXXXXXX

SEQ ID NO: 36190 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXTPAXXXXXXFXPPAPXXXXXAPWXX

SEQ ID NO: 36191 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXTPAXXXXXXFXPPAPXXPPXXXXPXX

SEQ ID NO: 36192 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXTPAXXXXXXFXPPAPXXXXXXXXXXX

SEQ ID NO: 36193 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXTPAXXXXXXFXPPAPXXFXPPAPXXX

SEQ ID NO: 36194 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXTPAXXXXXXFXPPAPXXDFTXFPPXX

SEQ ID NO: 36195 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXTPAXXXXXXFXPPAPXXXTPAXFXXX

SEQ ID NO: 36196 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXTPAXXXXXXFXPPAPXXXARXTPXSPPXX

SEQ ID NO: 36197 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXTPAXXXXXXFXPPAPXXXXTAYKPXXX

SEQ ID NO: 36198 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXTPAXXXXXXFXPPAPXXXAXXAPXIXXXX

SEQ ID NO: 36199 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXTPAXXXXXXFXPPAPXXHXXQPXAQEPXX

SEQ ID NO: 36200 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXTPAXXXXXXDFTXFPPXXXGFXLKXXXX

SEQ ID NO: 36201 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXTPAXXXXXXDFTXFPPXXXTPAXXXXXXX

SEQ ID NO: 36202 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXTPAXXXXXXDFTXFPPXXXXAPWXX

SEQ ID NO: 36203 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXTPAXXXXXXDFTXFPPXPPXXXXPXX

SEQ ID NO: 36204 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXTPAXXXXXXDFTXFPPXXXXXXXXXX

SEQ ID NO: 36205 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXTPAXXXXXXDFTXFPPXFXPPAPXXX

SEQ ID NO: 36206 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXTPAXXXXXXDFTXFPPXDFTXFPPXX

SEQ ID NO: 36207 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXTPAXXXXXXDFTXFPPXXTPAXFXXX

SEQ ID NO: 36208 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXTPAXXXXXXDFTXFPPXXARXTPXSPPXX

SEQ ID NO: 36209 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXTPAXXXXXXDFTXFPPXXXTAYKPXXX

SEQ ID NO: 36210 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXTPAXXXXXXDFTXFPPXXAXXAPXIXXXX

SEQ ID NO: 36211 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXTPAXXXXXXDFTXFPPXHXXQPXAQEPXX

SEQ ID NO: 36212 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXTPAXXXXXXXTPAXFXXXXGFXLKXXXX

SEQ ID NO: 36213 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXTPAXXXXXXXTPAXFXXXXTPAXXXXXXX

SEQ ID NO: 36214 - protein, 29 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXTPAXXXXXXXTPAXFXXXXXAPWXX

SEQ ID NO: 36215 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXTPAXXXXXXXTPAXFXXPPXXXXPXX

SEQ ID NO: 36216 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXTPAXXXXXXXTPAXFXXXXXXXXXXX

SEQ ID NO: 36217 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXTPAXXXXXXXTPAXFXXFXPPAPXXX

SEQ ID NO: 36218 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXTPAXXXXXXXTPAXFXXDFTXFPPXX

SEQ ID NO: 36219 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXTPAXXXXXXXTPAXFXXXTPAXFXXX

SEQ ID NO: 36220 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXTPAXXXXXXXTPAXFXXXARXTPXSPPXX

SEQ ID NO: 36221 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXTPAXXXXXXXTPAXFXXXXTAYKPXXX

SEQ ID NO: 36222 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXTPAXXXXXXXTPAXFXXXAXXAPXIXXXX

SEQ ID NO: 36223 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXTPAXXXXXXXTPAXFXXHXXQPXAQEPXX

SEQ ID NO: 36224 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXXTPAXXXXXXXARXTPXSPPXXXGFXLKXXXX

SEQ ID NO: 36225 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXXTPAXXXXXXXARXTPXSPPXXXTPAXXXXXXX

SEQ ID NO: 36226 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXXTPAXXXXXXXARXTPXSPPXXXXAPWXX

SEQ ID NO: 36227 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXXTPAXXXXXXXARXTPXSPPXPPXXXXPXX

SEQ ID NO: 36228 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXXTPAXXXXXXXARXTPXSPPXXXXXXXXXX

SEQ ID NO: 36229 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXXTPAXXXXXXXARXTPXSPPXFXPPAPXXX

SEQ ID NO: 36230 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXXTPAXXXXXXXARXTPXSPPXDFTXFPPXX

SEQ ID NO: 36231 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXXTPAXXXXXXXARXTPXSPPXXTPAXFXXX

SEQ ID NO: 36232 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXXTPAXXXXXXXARXTPXSPPXXARXTPXSPPXX

SEQ ID NO: 36233 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXXTPAXXXXXXXARXTPXSPPXXXTAYKPXXX

SEQ ID NO: 36234 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXXTPAXXXXXXXARXTPXSPPXXAXXAPXIXXXX

SEQ ID NO: 36235 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXXTPAXXXXXXXARXTPXSPPXHXXQPXAQEPXX

SEQ ID NO: 36236 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXXTPAXXXXXXXXTAYKPXXXXGFXLKXXXX

SEQ ID NO: 36237 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXXTPAXXXXXXXXTAYKPXXXXTPAXXXXXXX

SEQ ID NO: 36238 - protein, 30 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXXTPAXXXXXXXXTAYKPXXXXXAPWXX

SEQ ID NO: 36239 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXXTPAXXXXXXXXTAYKPXXPPXXXXPXX

SEQ ID NO: 36240 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXXTPAXXXXXXXXTAYKPXXXXXXXXXXX

SEQ ID NO: 36241 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXXTPAXXXXXXXXTAYKPXXFXPPAPXXX

SEQ ID NO: 36242 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXXTPAXXXXXXXXTAYKPXXDFTXFPPXX

SEQ ID NO: 36243 - protein, 31 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXXTPAXXXXXXXXTAYKPXXXTPAXFXXX

SEQ ID NO: 36244 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXXTPAXXXXXXXXTAYKPXXXARXTPXSPPXX

SEQ ID NO: 36245 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXXTPAXXXXXXXXTAYKPXXXXTAYKPXXX

SEQ ID NO: 36246 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXXTPAXXXXXXXXTAYKPXXXAXXAPXIXXXX

SEQ ID NO: 36247 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXXTPAXXXXXXXXTAYKPXXHXXQPXAQEPXX

SEQ ID NO: 36248 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXXTPAXXXXXXXAXXAPXIXXXXXGFXLKXXXX

SEQ ID NO: 36249 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXXTPAXXXXXXXAXXAPXIXXXXXTPAXXXXXXX

SEQ ID NO: 36250 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXXTPAXXXXXXXAXXAPXIXXXXXXAPWXX

SEQ ID NO: 36251 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXXTPAXXXXXXXAXXAPXIXXXPPXXXXPXX

SEQ ID NO: 36252 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXXTPAXXXXXXXAXXAPXIXXXXXXXXXXXX

SEQ ID NO: 36253 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXXTPAXXXXXXXAXXAPXIXXXFXPPAPXXX

SEQ ID NO: 36254 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXXTPAXXXXXXXAXXAPXIXXXDFTXFPPXX

SEQ ID NO: 36255 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXXTPAXXXXXXXAXXAPXIXXXXTPAXFXXX

SEQ ID NO: 36256 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXXTPAXXXXXXXAXXAPXIXXXXARXTPXSPPXX

SEQ ID NO: 36257 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXXTPAXXXXXXXAXXAPXIXXXXXTAYKPXXX

SEQ ID NO: 36258 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXXTPAXXXXXXXAXXAPXIXXXXAXXAPXIXXXX

SEQ ID NO: 36259 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXXTPAXXXXXXXAXXAPXIXXXHXXQPXAQEPXX

SEQ ID NO: 36260 - protein, 35 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXXTPAXXXXXXHXXQPXAQEPXXXGFXLKXXXX

SEQ ID NO: 36261 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXXTPAXXXXXXHXXQPXAQEPXXXTPAXXXXXXX

SEQ ID NO: 36262 - protein, 32 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXXTPAXXXXXXHXXQPXAQEPXXXXAPWXX

SEQ ID NO: 36263 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXXTPAXXXXXXHXXQPXAQEPXPPXXXXPXX

SEQ ID NO: 36264 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXXTPAXXXXXXHXXQPXAQEPXXXXXXXXXX

SEQ ID NO: 36265 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXXTPAXXXXXXHXXQPXAQEPXFXPPAPXXX

SEQ ID NO: 36266 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXXTPAXXXXXXHXXQPXAQEPXDFTXFPPXX

SEQ ID NO: 36267 - protein, 33 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXXTPAXXXXXXHXXQPXAQEPXXTPAXFXXX

SEQ ID NO: 36268 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXXTPAXXXXXXHXXQPXAQEPXXARXTPXSPPXX

SEQ ID NO: 36269 - protein, 34 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXXTPAXXXXXXHXXQPXAQEPXXXTAYKPXXX

SEQ ID NO: 36270 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXXTPAXXXXXXHXXQPXAQEPXXAXXAPXIXXXX

SEQ ID NO: 36271 - protein, 36 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXXTPAXXXXXXHXXQPXAQEPXHXXQPXAQEPXX

SEQ ID NO: 36272 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXXAPWXXXGFXLKXXXXXGFXLKXXXX

SEQ ID NO: 36273 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXXAPWXXXGFXLKXXXXXTPAXXXXXXX

SEQ ID NO: 36274 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXXAPWXXXGFXLKXXXXXXAPWXX

SEQ ID NO: 36275 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXXAPWXXXGFXLKXXXPPXXXXPXX

SEQ ID NO: 36276 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXXAPWXXXGFXLKXXXXXXXXXXXX

SEQ ID NO: 36277 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXXAPWXXXGFXLKXXXFXPPAPXXX

SEQ ID NO: 36278 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXXAPWXXXGFXLKXXXDFTXFPPXX

SEQ ID NO: 36279 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXXAPWXXXGFXLKXXXXTPAXFXXX

SEQ ID NO: 36280 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXXAPWXXXGFXLKXXXXARXTPXSPPXX

SEQ ID NO: 36281 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXXAPWXXXGFXLKXXXXXTAYKPXXX

SEQ ID NO: 36282 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXXAPWXXXGFXLKXXXXAXXAPXIXXXX

SEQ ID NO: 36283 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (14)..(14): Xaa = any amino acid, non amino acid, or is absent
  MISC_FEATURE (17)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXXAPWXXXGFXLKXXXHXXQPXAQEPXX

SEQ ID NO: 36284 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXXAPWXXXTPAXXXXXXXXGFXLKXXXX

SEQ ID NO: 36285 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXXAPWXXXTPAXXXXXXXXTPAXXXXXXX

SEQ ID NO: 36286 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXXAPWXXXTPAXXXXXXXXXAPWXX

SEQ ID NO: 36287 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXXAPWXXXTPAXXXXXXPPXXXXPXX

SEQ ID NO: 36288 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXXAPWXXXTPAXXXXXXXXXXXXXXX

SEQ ID NO: 36289 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXXAPWXXXTPAXXXXXXFXPPAPXXX

SEQ ID NO: 36290 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXXAPWXXXTPAXXXXXXDFTXFPPXX

SEQ ID NO: 36291 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXXAPWXXXTPAXXXXXXXTPAXFXXX

SEQ ID NO: 36292 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXXAPWXXXTPAXXXXXXXARXTPXSPPXX

SEQ ID NO: 36293 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXXAPWXXXTPAXXXXXXXXTAYKPXXX

SEQ ID NO: 36294 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXXAPWXXXTPAXXXXXXXAXXAPXIXXXX

SEQ ID NO: 36295 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(11): Xaa = any amino acid, non amino acid, or is absent
  MISC_FEATURE (15)..(15): Xaa = Asn or Asp
  MISC_FEATURE (16)..(16): Xaa = Asn or Glu
  MISC_FEATURE (17)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXXAPWXXXTPAXXXXXXHXXQPXAQEPXX

SEQ ID NO: 36296 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(18): Xaa = any amino acid, non amino acid, or is absent
  MISC_FEATURE (21)..(21): Xaa = any amino acid, non amino acid, or is absent
  MISC_FEATURE (24)..(27): Xaa = any amino acid, non amino acid, or is absent
XXXXXAPWXXXXAPWXXXGFXLKXXXX

SEQ ID NO: 36297 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(18): Xaa = any amino acid, non amino acid, or is absent
  MISC_FEATURE (22)..(22): Xaa = Asn or Asp
  MISC_FEATURE (23)..(23): Xaa = Asn or Glu
  MISC_FEATURE (24)..(28): Xaa = any amino acid, non amino acid, or is absent
XXXXXAPWXXXXAPWXXXTPAXXXXXXX

SEQ ID NO: 36298 - protein, 24 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (17)..(17): Xaa = Ile, Phe, Trp, Tyr or Ala
  MISC_FEATURE (18)..(18): Xaa = Asp, Ala, Gln, Glu, Gly, His, Ile, Leu, Phe, Pro, Thr or Tyr
  MISC_FEATURE (19)..(19): Xaa = Gln, Leu, Trp or Tyr
  MISC_FEATURE (23)..(24): Xaa = any amino acid, non amino acid, or is absent
XXXXXAPWXXXXAPWXXXXAPWXX

SEQ ID NO: 36299 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (19)..(19): Xaa = Tyr or Pro
  MISC_FEATURE (20)..(20): Xaa = Trp, Tyr, Phe, Ala, Val, Cys, Thr, Leu, Ser, His, Gln, Glu, Gly or Ile
  MISC_FEATURE (21)..(21): Xaa = Trp, Ile, Phe, Pro, Asp, Gly, Cys or Ala
  MISC_FEATURE (22)..(22): Xaa = Gly or Asn
  MISC_FEATURE (24)..(25): Xaa = any amino acid, non amino acid, or is absent
XXXXXAPWXXXXAPWXPPXXXXPXX

SEQ ID NO: 36300 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (17)..(17): Xaa = Gly, Tyr or Trp
  MISC_FEATURE (18)..(18): Xaa = Trp, Val, Ile, Phe, Arg, Met, Ser or Leu
  MISC_FEATURE (19)..(19): Xaa = Ile or Gly
  MISC_FEATURE (20)..(20): Xaa = Tyr, Pro, His, Leu or Phe
  MISC_FEATURE (21)..(21): Xaa = Ile, Asp, Tyr, Phe, Val, Thr, Gly, Ala or Gln
  MISC_FEATURE (22)..(22): Xaa = Phe, Arg, Cys, Leu, Ala, Gln, Asp or Val
  MISC_FEATURE (23)..(23): Xaa = Phe or Tyr
  MISC_FEATURE (24)..(25): Xaa = any amino acid, non amino acid, or is absent
XXXXXAPWXXXXAPWXXXXXXXXXX

SEQ ID NO: 36301 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (18)..(18): Xaa = Pro or Ser
  MISC_FEATURE (23)..(23): Xaa = Pro, Tyr, Leu, Ala, Glu, Gly, Val or Ile
  MISC_FEATURE (24)..(25): Xaa = any amino acid, non amino acid, or is absent
XXXXXAPWXXXXAPWXFXPPAPXXX

SEQ ID NO: 36302 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (20)..(20): Xaa = Val or Ile
  MISC_FEATURE (24)..(25): Xaa = any amino acid, non amino acid, or is absent
XXXXXAPWXXXXAPWXDFTXFPPXX

SEQ ID NO: 36303 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (17)..(17): Xaa = Tyr, Thr or His
  MISC_FEATURE (21)..(21): Xaa = His or Ile
  MISC_FEATURE (23)..(23): Xaa = Tyr or Ala
  MISC_FEATURE (24)..(25): Xaa = any amino acid, non amino acid, or is absent
XXXXXAPWXXXXAPWXXTPAXFXXX

SEQ ID NO: 36304 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (17)..(17): Xaa = Pro or Ala
  MISC_FEATURE (20)..(20): Xaa = Ala, Pro, Trp, Asn or Leu
  MISC_FEATURE (23)..(23): Xaa = Pro or Phe
  MISC_FEATURE (27)..(28): Xaa = any amino acid, non amino acid, or is absent
XXXXXAPWXXXXAPWXXARXTPXSPPXX

SEQ ID NO: 36305 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (17)..(17): Xaa = Trp or Leu
  MISC_FEATURE (18)..(18): Xaa = Ala, Asn, Ser, Trp or Glu
  MISC_FEATURE (24)..(24): Xaa = Ser or Phe
  MISC_FEATURE (25)..(26): Xaa = any amino acid, non amino acid, or is absent
XXXXXAPWXXXXAPWXXXTAYKPXXX

SEQ ID NO: 36306 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (17)..(17): Xaa = Asn, Trp or Ala
  MISC_FEATURE (19)..(19): Xaa = Phe, Asn, Tyr or Pro
  MISC_FEATURE (20)..(20): Xaa = Pro, His, Tyr, Trp or Ala
  MISC_FEATURE (23)..(23): Xaa = Tyr or Ala
  MISC_FEATURE (25)..(25): Xaa = Trp or Gln
  MISC_FEATURE (26)..(26): Xaa = Arg or Gln
  MISC_FEATURE (27)..(28): Xaa = any amino acid, non amino acid, or is absent
XXXXXAPWXXXXAPWXXAXXAPXIXXXX

SEQ ID NO: 36307 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Ile, Phe, Trp, Tyr or Ala
  MISC_FEATURE (11)..(11): Xaa = Asp, Ala, Gln, Glu, Gly, His, Ile, Leu, Phe, Pro, Thr or Tyr
  MISC_FEATURE (12)..(12): Xaa = Gln, Leu, Trp or Tyr
  MISC_FEATURE (16)..(16): Xaa = any amino acid, non amino acid, or is absent
  MISC_FEATURE (18)..(18): Xaa = Glu, Gly, Trp or Phe
  MISC_FEATURE (19)..(19): Xaa = Gly, Ala or Asn
  MISC_FEATURE (22)..(22): Xaa = His, Trp or Lys
  MISC_FEATURE (27)..(28): Xaa = any amino acid, non amino acid, or is absent
XXXXXAPWXXXXAPWXHXXQPXAQEPXX

SEQ ID NO: 36308 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXXXXAPWXPPXXXXPXXXGFXLKXXXX

SEQ ID NO: 36309 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXXXXAPWXPPXXXXPXXXTPAXXXXXXX

SEQ ID NO: 36310 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXXXXAPWXPPXXXXPXXXXAPWXX

SEQ ID NO: 36311 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXXXXAPWXPPXXXXPXPPXXXXPXX

SEQ ID NO: 36312 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXXXXAPWXPPXXXXPXXXXXXXXXX

SEQ ID NO: 36313 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXXXXAPWXPPXXXXPXFXPPAPXXX

SEQ ID NO: 36314 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXXXXAPWXPPXXXXPXDFTXFPPXX

SEQ ID NO: 36315 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXXXXAPWXPPXXXXPXXTPAXFXXX

SEQ ID NO: 36316 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXXXXAPWXPPXXXXPXXARXTPXSPPXX

SEQ ID NO: 36317 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXXXXAPWXPPXXXXPXXXTAYKPXXX

SEQ ID NO: 36318 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXXXXAPWXPPXXXXPXXAXXAPXIXXXX

SEQ ID NO: 36319 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (12)..(12): Xaa = Tyr or Pro
  MISC_FEATURE (13)..(13): Xaa = Trp, Tyr, Phe, Ala, Val, Cys, Thr, Leu, Ser, His, Gln, Glu, Gly or Ile
  MISC_FEATURE (14)..(14): Xaa = Trp, Ile, Phe, Pro, Asp, Gly, Cys or Ala
  MISC_FEATURE (15)..(15): Xaa = Gly or Asn
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXXXXAPWXPPXXXXPXHXXQPXAQEPXX

SEQ ID NO: 36320 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXXXXAPWXXXXXXXXXXXGFXLKXXXX

SEQ ID NO: 36321 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXXXXAPWXXXXXXXXXXXTPAXXXXXXX

SEQ ID NO: 36322 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXXXXAPWXXXXXXXXXXXXAPWXX

SEQ ID NO: 36323 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXXXXAPWXXXXXXXXXPPXXXXPXX

SEQ ID NO: 36324 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXXXXAPWXXXXXXXXXXXXXXXXXX

SEQ ID NO: 36325 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXXXXAPWXXXXXXXXXFXPPAPXXX

SEQ ID NO: 36326 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXXXXAPWXXXXXXXXXDFTXFPPXX

SEQ ID NO: 36327 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXXXXAPWXXXXXXXXXXTPAXFXXX

SEQ ID NO: 36328 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXXXXAPWXXXXXXXXXXARXTPXSPPXX

SEQ ID NO: 36329 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXXXXAPWXXXXXXXXXXXTAYKPXXX

SEQ ID NO: 36330 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXXXXAPWXXXXXXXXXXAXXAPXIXXXX

SEQ ID NO: 36331 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Gly, Tyr or Trp
  MISC_FEATURE (11)..(11): Xaa = Trp, Val, Ile, Phe, Arg, Met, Ser or Leu
  MISC_FEATURE (12)..(12): Xaa = Ile or Gly
  MISC_FEATURE (13)..(13): Xaa = Tyr, Pro, His, Leu or Phe
  MISC_FEATURE (14)..(14): Xaa = Ile, Asp, Tyr, Phe, Val, Thr, Gly, Ala or Gln
  MISC_FEATURE (15)..(15): Xaa = Phe, Arg, Cys, Leu, Ala, Gln, Asp or Val
  MISC_FEATURE (16)..(16): Xaa = Phe or Tyr
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXXXXAPWXXXXXXXXXHXXQPXAQEPXX

SEQ ID NO: 36332 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXXXXAPWXFXPPAPXXXXGFXLKXXXX

SEQ ID NO: 36333 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXXXXAPWXFXPPAPXXXXTPAXXXXXXX

SEQ ID NO: 36334 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXXXXAPWXFXPPAPXXXXXAPWXX

SEQ ID NO: 36335 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXXXXAPWXFXPPAPXXPPXXXXPXX

SEQ ID NO: 36336 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXXXXAPWXFXPPAPXXXXXXXXXXX

SEQ ID NO: 36337 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXXXXAPWXFXPPAPXXFXPPAPXXX

SEQ ID NO: 36338 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXXXXAPWXFXPPAPXXDFTXFPPXX

SEQ ID NO: 36339 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXXXXAPWXFXPPAPXXXTPAXFXXX

SEQ ID NO: 36340 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXXXXAPWXFXPPAPXXXARXTPXSPPXX

SEQ ID NO: 36341 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXXXXAPWXFXPPAPXXXXTAYKPXXX

SEQ ID NO: 36342 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXXXXAPWXFXPPAPXXXAXXAPXIXXXX

SEQ ID NO: 36343 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Pro or Ser
  MISC_FEATURE (16)..(16): Xaa = Pro, Tyr, Leu, Ala, Glu, Gly, Val or Ile
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXXXXAPWXFXPPAPXXHXXQPXAQEPXX

SEQ ID NO: 36344 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXXXXAPWXDFTXFPPXXXGFXLKXXXX

SEQ ID NO: 36345 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXXXXAPWXDFTXFPPXXXTPAXXXXXXX

SEQ ID NO: 36346 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXXXXAPWXDFTXFPPXXXXAPWXX

SEQ ID NO: 36347 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXXXXAPWXDFTXFPPXPPXXXXPXX

SEQ ID NO: 36348 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXXXXAPWXDFTXFPPXXXXXXXXXX

SEQ ID NO: 36349 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXXXXAPWXDFTXFPPXFXPPAPXXX

SEQ ID NO: 36350 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXXXXAPWXDFTXFPPXDFTXFPPXX

SEQ ID NO: 36351 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXXXXAPWXDFTXFPPXXTPAXFXXX

SEQ ID NO: 36352 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXXXXAPWXDFTXFPPXXARXTPXSPPXX

SEQ ID NO: 36353 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXXXXAPWXDFTXFPPXXXTAYKPXXX

SEQ ID NO: 36354 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXXXXAPWXDFTXFPPXXAXXAPXIXXXX

SEQ ID NO: 36355 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (13)..(13): Xaa = Val or Ile
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXXXXAPWXDFTXFPPXHXXQPXAQEPXX

SEQ ID NO: 36356 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXXXXAPWXXTPAXFXXXXGFXLKXXXX

SEQ ID NO: 36357 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXXXXAPWXXTPAXFXXXXTPAXXXXXXX

SEQ ID NO: 36358 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXXXXAPWXXTPAXFXXXXXAPWXX

SEQ ID NO: 36359 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXXXXAPWXXTPAXFXXPPXXXXPXX

SEQ ID NO: 36360 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXXXXAPWXXTPAXFXXXXXXXXXXX

SEQ ID NO: 36361 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXXXXAPWXXTPAXFXXFXPPAPXXX

SEQ ID NO: 36362 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXXXXAPWXXTPAXFXXDFTXFPPXX

SEQ ID NO: 36363 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXXXXAPWXXTPAXFXXXTPAXFXXX

SEQ ID NO: 36364 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXXXXAPWXXTPAXFXXXARXTPXSPPXX

SEQ ID NO: 36365 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXXXXAPWXXTPAXFXXXXTAYKPXXX

SEQ ID NO: 36366 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXXXXAPWXXTPAXFXXXAXXAPXIXXXX

SEQ ID NO: 36367 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Tyr, Thr or His
  MISC_FEATURE (14)..(14): Xaa = His or Ile
  MISC_FEATURE (16)..(16): Xaa = Tyr or Ala
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXXXXAPWXXTPAXFXXHXXQPXAQEPXX

SEQ ID NO: 36368 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXXAPWXXARXTPXSPPXXXGFXLKXXXX

SEQ ID NO: 36369 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXXAPWXXARXTPXSPPXXXTPAXXXXXXX

SEQ ID NO: 36370 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXXAPWXXARXTPXSPPXXXXAPWXX

SEQ ID NO: 36371 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXXAPWXXARXTPXSPPXPPXXXXPXX

SEQ ID NO: 36372 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXXAPWXXARXTPXSPPXXXXXXXXXX

SEQ ID NO: 36373 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXXAPWXXARXTPXSPPXFXPPAPXXX

SEQ ID NO: 36374 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXXAPWXXARXTPXSPPXDFTXFPPXX

SEQ ID NO: 36375 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXXAPWXXARXTPXSPPXXTPAXFXXX

SEQ ID NO: 36376 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXXAPWXXARXTPXSPPXXARXTPXSPPXX

SEQ ID NO: 36377 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXXAPWXXARXTPXSPPXXXTAYKPXXX

SEQ ID NO: 36378 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXXAPWXXARXTPXSPPXXAXXAPXIXXXX

SEQ ID NO: 36379 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Pro or Ala
  MISC_FEATURE (13)..(13): Xaa = Ala, Pro, Trp, Asn or Leu
  MISC_FEATURE (16)..(16): Xaa = Pro or Phe
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXXAPWXXARXTPXSPPXHXXQPXAQEPXX

SEQ ID NO: 36380 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXXXAPWXXXTAYKPXXXXGFXLKXXXX

SEQ ID NO: 36381 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXXXAPWXXXTAYKPXXXXTPAXXXXXXX

SEQ ID NO: 36382 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXXXAPWXXXTAYKPXXXXXAPWXX

SEQ ID NO: 36383 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXXXAPWXXXTAYKPXXPPXXXXPXX

SEQ ID NO: 36384 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXXXAPWXXXTAYKPXXXXXXXXXXX

SEQ ID NO: 36385 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXXXAPWXXXTAYKPXXFXPPAPXXX

SEQ ID NO: 36386 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXXXAPWXXXTAYKPXXDFTXFPPXX

SEQ ID NO: 36387 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXXXAPWXXXTAYKPXXXTPAXFXXX

SEQ ID NO: 36388 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXXXAPWXXXTAYKPXXXARXTPXSPPXX

SEQ ID NO: 36389 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXXXAPWXXXTAYKPXXXXTAYKPXXX

SEQ ID NO: 36390 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXXXAPWXXXTAYKPXXXAXXAPXIXXXX

SEQ ID NO: 36391 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Trp or Leu
  MISC_FEATURE (11)..(11): Xaa = Ala, Asn, Ser, Trp or Glu
  MISC_FEATURE (17)..(17): Xaa = Ser or Phe
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXXXAPWXXXTAYKPXXHXXQPXAQEPXX

SEQ ID NO: 36392 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXXAPWXXAXXAPXIXXXXXGFXLKXXXX

SEQ ID NO: 36393 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXXAPWXXAXXAPXIXXXXXTPAXXXXXXX

SEQ ID NO: 36394 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXXAPWXXAXXAPXIXXXXXXAPWXX

SEQ ID NO: 36395 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXXAPWXXAXXAPXIXXXPPXXXXPXX

SEQ ID NO: 36396 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXXAPWXXAXXAPXIXXXXXXXXXXXX

SEQ ID NO: 36397 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXXAPWXXAXXAPXIXXXFXPPAPXXX

SEQ ID NO: 36398 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXXAPWXXAXXAPXIXXXDFTXFPPXX

SEQ ID NO: 36399 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXXAPWXXAXXAPXIXXXXTPAXFXXX

SEQ ID NO: 36400 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXXAPWXXAXXAPXIXXXXARXTPXSPPXX

SEQ ID NO: 36401 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXXAPWXXAXXAPXIXXXXXTAYKPXXX

SEQ ID NO: 36402 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXXAPWXXAXXAPXIXXXXAXXAPXIXXXX

SEQ ID NO: 36403 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (10)..(10): Xaa = Asn, Trp or Ala
  MISC_FEATURE (12)..(12): Xaa = Phe, Asn, Tyr or Pro
  MISC_FEATURE (13)..(13): Xaa = Pro, His, Tyr, Trp or Ala
  MISC_FEATURE (16)..(16): Xaa = Tyr or Ala
  MISC_FEATURE (18)..(18): Xaa = Trp or Gln
  MISC_FEATURE (19)..(19): Xaa = Arg or Gln
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXXAPWXXAXXAPXIXXXHXXQPXAQEPXX

SEQ ID NO: 36404 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXXAPWXHXXQPXAQEPXXXGFXLKXXXX

SEQ ID NO: 36405 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXXAPWXHXXQPXAQEPXXXTPAXXXXXXX

SEQ ID NO: 36406 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXXAPWXHXXQPXAQEPXXXXAPWXX

SEQ ID NO: 36407 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXXAPWXHXXQPXAQEPXPPXXXXPXX

SEQ ID NO: 36408 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXXAPWXHXXQPXAQEPXXXXXXXXXX

SEQ ID NO: 36409 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXXAPWXHXXQPXAQEPXFXPPAPXXX

SEQ ID NO: 36410 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXXAPWXHXXQPXAQEPXDFTXFPPXX

SEQ ID NO: 36411 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXXAPWXHXXQPXAQEPXXTPAXFXXX

SEQ ID NO: 36412 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXXAPWXHXXQPXAQEPXXARXTPXSPPXX

SEQ ID NO: 36413 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXXAPWXHXXQPXAQEPXXXTAYKPXXX

SEQ ID NO: 36414 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXXAPWXHXXQPXAQEPXXAXXAPXIXXXX

SEQ ID NO: 36415 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(9): Xaa = any amino acid, non amino acid, or is absent
  MISC_FEATURE (11)..(11): Xaa = Glu, Gly, Trp or Phe
  MISC_FEATURE (12)..(12): Xaa = Gly, Ala or Asn
  MISC_FEATURE (15)..(15): Xaa = His, Trp or Lys
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXXAPWXHXXQPXAQEPXHXXQPXAQEPXX

SEQ ID NO: 36416 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXPPXXXXPXXXGFXLKXXXXXGFXLKXXXX

SEQ ID NO: 36417 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXPPXXXXPXXXGFXLKXXXXXTPAXXXXXXX

SEQ ID NO: 36418 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXPPXXXXPXXXGFXLKXXXXXXAPWXX

SEQ ID NO: 36419 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXPPXXXXPXXXGFXLKXXXPPXXXXPXX

SEQ ID NO: 36420 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXPPXXXXPXXXGFXLKXXXXXXXXXXXX

SEQ ID NO: 36421 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXPPXXXXPXXXGFXLKXXXFXPPAPXXX

SEQ ID NO: 36422 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXPPXXXXPXXXGFXLKXXXDFTXFPPXX

SEQ ID NO: 36423 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXPPXXXXPXXXGFXLKXXXXTPAXFXXX

SEQ ID NO: 36424 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXPPXXXXPXXXGFXLKXXXXARXTPXSPPXX

SEQ ID NO: 36425 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXPPXXXXPXXXGFXLKXXXXXTAYKPXXX

SEQ ID NO: 36426 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXPPXXXXPXXXGFXLKXXXXAXXAPXIXXXX

SEQ ID NO: 36427 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXPPXXXXPXXXGFXLKXXXHXXQPXAQEPXX

SEQ ID NO: 36428 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXPPXXXXPXXXTPAXXXXXXXXGFXLKXXXX

SEQ ID NO: 36429 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXPPXXXXPXXXTPAXXXXXXXXTPAXXXXXXX

SEQ ID NO: 36430 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXPPXXXXPXXXTPAXXXXXXXXXAPWXX

SEQ ID NO: 36431 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXPPXXXXPXXXTPAXXXXXXPPXXXXPXX

SEQ ID NO: 36432 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXPPXXXXPXXXTPAXXXXXXXXXXXXXXX

SEQ ID NO: 36433 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXPPXXXXPXXXTPAXXXXXXFXPPAPXXX

SEQ ID NO: 36434 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXPPXXXXPXXXTPAXXXXXXDFTXFPPXX

SEQ ID NO: 36435 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXPPXXXXPXXXTPAXXXXXXXTPAXFXXX

SEQ ID NO: 36436 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXPPXXXXPXXXTPAXXXXXXXARXTPXSPPXX

SEQ ID NO: 36437 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXPPXXXXPXXXTPAXXXXXXXXTAYKPXXX

SEQ ID NO: 36438 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXPPXXXXPXXXTPAXXXXXXXAXXAPXIXXXX

SEQ ID NO: 36439 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXPPXXXXPXXXTPAXXXXXXHXXQPXAQEPXX

SEQ ID NO: 36440 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXPPXXXXPXXXXAPWXXXGFXLKXXXX

SEQ ID NO: 36441 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXPPXXXXPXXXXAPWXXXTPAXXXXXXX

SEQ ID NO: 36442 - protein, 25 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXPPXXXXPXXXXAPWXXXXAPWXX

SEQ ID NO: 36443 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXPPXXXXPXXXXAPWXPPXXXXPXX

SEQ ID NO: 36444 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXPPXXXXPXXXXAPWXXXXXXXXXX

SEQ ID NO: 36445 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXPPXXXXPXXXXAPWXFXPPAPXXX

SEQ ID NO: 36446 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXPPXXXXPXXXXAPWXDFTXFPPXX

SEQ ID NO: 36447 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXPPXXXXPXXXXAPWXXTPAXFXXX

SEQ ID NO: 36448 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXPPXXXXPXXXXAPWXXARXTPXSPPXX

SEQ ID NO: 36449 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXPPXXXXPXXXXAPWXXXTAYKPXXX

SEQ ID NO: 36450 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXPPXXXXPXXXXAPWXXAXXAPXIXXXX

SEQ ID NO: 36451 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXPPXXXXPXXXXAPWXHXXQPXAQEPXX

SEQ ID NO: 36452 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXPPXXXXPXPPXXXXPXXXGFXLKXXXX

SEQ ID NO: 36453 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXPPXXXXPXPPXXXXPXXXTPAXXXXXXX

SEQ ID NO: 36454 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXPPXXXXPXPPXXXXPXXXXAPWXX

SEQ ID NO: 36455 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXPPXXXXPXPPXXXXPXPPXXXXPXX

SEQ ID NO: 36456 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXPPXXXXPXPPXXXXPXXXXXXXXXX

SEQ ID NO: 36457 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXPPXXXXPXPPXXXXPXFXPPAPXXX

SEQ ID NO: 36458 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXPPXXXXPXPPXXXXPXDFTXFPPXX

SEQ ID NO: 36459 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXPPXXXXPXPPXXXXPXXTPAXFXXX

SEQ ID NO: 36460 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXPPXXXXPXPPXXXXPXXARXTPXSPPXX

SEQ ID NO: 36461 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXPPXXXXPXPPXXXXPXXXTAYKPXXX

SEQ ID NO: 36462 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXPPXXXXPXPPXXXXPXXAXXAPXIXXXX

SEQ ID NO: 36463 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXPPXXXXPXPPXXXXPXHXXQPXAQEPXX

SEQ ID NO: 36464 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXPPXXXXPXXXXXXXXXXXGFXLKXXXX

SEQ ID NO: 36465 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXPPXXXXPXXXXXXXXXXXTPAXXXXXXX

SEQ ID NO: 36466 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXPPXXXXPXXXXXXXXXXXXAPWXX

SEQ ID NO: 36467 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXPPXXXXPXXXXXXXXXPPXXXXPXX

SEQ ID NO: 36468 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXPPXXXXPXXXXXXXXXXXXXXXXXX

SEQ ID NO: 36469 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXPPXXXXPXXXXXXXXXFXPPAPXXX

SEQ ID NO: 36470 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXPPXXXXPXXXXXXXXXDFTXFPPXX

SEQ ID NO: 36471 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXPPXXXXPXXXXXXXXXXTPAXFXXX

SEQ ID NO: 36472 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXPPXXXXPXXXXXXXXXXARXTPXSPPXX

SEQ ID NO: 36473 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXPPXXXXPXXXXXXXXXXXTAYKPXXX

SEQ ID NO: 36474 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXPPXXXXPXXXXXXXXXXAXXAPXIXXXX

SEQ ID NO: 36475 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXPPXXXXPXXXXXXXXXHXXQPXAQEPXX

SEQ ID NO: 36476 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXPPXXXXPXFXPPAPXXXXGFXLKXXXX

SEQ ID NO: 36477 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXPPXXXXPXFXPPAPXXXXTPAXXXXXXX

SEQ ID NO: 36478 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXPPXXXXPXFXPPAPXXXXXAPWXX

SEQ ID NO: 36479 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXPPXXXXPXFXPPAPXXPPXXXXPXX

SEQ ID NO: 36480 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXPPXXXXPXFXPPAPXXXXXXXXXXX

SEQ ID NO: 36481 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXPPXXXXPXFXPPAPXXFXPPAPXXX

SEQ ID NO: 36482 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXPPXXXXPXFXPPAPXXDFTXFPPXX

SEQ ID NO: 36483 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXPPXXXXPXFXPPAPXXXTPAXFXXX

SEQ ID NO: 36484 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXPPXXXXPXFXPPAPXXXARXTPXSPPXX

SEQ ID NO: 36485 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXPPXXXXPXFXPPAPXXXXTAYKPXXX

SEQ ID NO: 36486 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXPPXXXXPXFXPPAPXXXAXXAPXIXXXX

SEQ ID NO: 36487 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXPPXXXXPXFXPPAPXXHXXQPXAQEPXX

SEQ ID NO: 36488 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXPPXXXXPXDFTXFPPXXXGFXLKXXXX

SEQ ID NO: 36489 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXPPXXXXPXDFTXFPPXXXTPAXXXXXXX

SEQ ID NO: 36490 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXPPXXXXPXDFTXFPPXXXXAPWXX

SEQ ID NO: 36491 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXPPXXXXPXDFTXFPPXPPXXXXPXX

SEQ ID NO: 36492 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXPPXXXXPXDFTXFPPXXXXXXXXXX

SEQ ID NO: 36493 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXPPXXXXPXDFTXFPPXFXPPAPXXX

SEQ ID NO: 36494 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXPPXXXXPXDFTXFPPXDFTXFPPXX

SEQ ID NO: 36495 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXPPXXXXPXDFTXFPPXXTPAXFXXX

SEQ ID NO: 36496 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXPPXXXXPXDFTXFPPXXARXTPXSPPXX

SEQ ID NO: 36497 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXPPXXXXPXDFTXFPPXXXTAYKPXXX

SEQ ID NO: 36498 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXPPXXXXPXDFTXFPPXXAXXAPXIXXXX

SEQ ID NO: 36499 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXPPXXXXPXDFTXFPPXHXXQPXAQEPXX

SEQ ID NO: 36500 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXPPXXXXPXXTPAXFXXXXGFXLKXXXX

SEQ ID NO: 36501 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXPPXXXXPXXTPAXFXXXXTPAXXXXXXX

SEQ ID NO: 36502 - protein, 26 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXPPXXXXPXXTPAXFXXXXXAPWXX

SEQ ID NO: 36503 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXPPXXXXPXXTPAXFXXPPXXXXPXX

SEQ ID NO: 36504 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXPPXXXXPXXTPAXFXXXXXXXXXXX

SEQ ID NO: 36505 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXPPXXXXPXXTPAXFXXFXPPAPXXX

SEQ ID NO: 36506 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXPPXXXXPXXTPAXFXXDFTXFPPXX

SEQ ID NO: 36507 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXPPXXXXPXXTPAXFXXXTPAXFXXX

SEQ ID NO: 36508 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXPPXXXXPXXTPAXFXXXARXTPXSPPXX

SEQ ID NO: 36509 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXPPXXXXPXXTPAXFXXXXTAYKPXXX

SEQ ID NO: 36510 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXPPXXXXPXXTPAXFXXXAXXAPXIXXXX

SEQ ID NO: 36511 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXPPXXXXPXXTPAXFXXHXXQPXAQEPXX

SEQ ID NO: 36512 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXPPXXXXPXXARXTPXSPPXXXGFXLKXXXX

SEQ ID NO: 36513 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXPPXXXXPXXARXTPXSPPXXXTPAXXXXXXX

SEQ ID NO: 36514 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXPPXXXXPXXARXTPXSPPXXXXAPWXX

SEQ ID NO: 36515 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXPPXXXXPXXARXTPXSPPXPPXXXXPXX

SEQ ID NO: 36516 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXPPXXXXPXXARXTPXSPPXXXXXXXXXX

SEQ ID NO: 36517 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXPPXXXXPXXARXTPXSPPXFXPPAPXXX

SEQ ID NO: 36518 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXPPXXXXPXXARXTPXSPPXDFTXFPPXX

SEQ ID NO: 36519 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXPPXXXXPXXARXTPXSPPXXTPAXFXXX

SEQ ID NO: 36520 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXPPXXXXPXXARXTPXSPPXXARXTPXSPPXX

SEQ ID NO: 36521 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXPPXXXXPXXARXTPXSPPXXXTAYKPXXX

SEQ ID NO: 36522 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXPPXXXXPXXARXTPXSPPXXAXXAPXIXXXX

SEQ ID NO: 36523 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXPPXXXXPXXARXTPXSPPXHXXQPXAQEPXX

SEQ ID NO: 36524 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXPPXXXXPXXXTAYKPXXXXGFXLKXXXX

SEQ ID NO: 36525 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXPPXXXXPXXXTAYKPXXXXTPAXXXXXXX

SEQ ID NO: 36526 - protein, 27 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXPPXXXXPXXXTAYKPXXXXXAPWXX

SEQ ID NO: 36527 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXPPXXXXPXXXTAYKPXXPPXXXXPXX

SEQ ID NO: 36528 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXPPXXXXPXXXTAYKPXXXXXXXXXXX

SEQ ID NO: 36529 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXPPXXXXPXXXTAYKPXXFXPPAPXXX

SEQ ID NO: 36530 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXPPXXXXPXXXTAYKPXXDFTXFPPXX

SEQ ID NO: 36531 - protein, 28 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXPPXXXXPXXXTAYKPXXXTPAXFXXX

SEQ ID NO: 36532 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXPPXXXXPXXXTAYKPXXXARXTPXSPPXX

SEQ ID NO: 36533 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXPPXXXXPXXXTAYKPXXXXTAYKPXXX

SEQ ID NO: 36534 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXPPXXXXPXXXTAYKPXXXAXXAPXIXXXX

SEQ ID NO: 36535 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXPPXXXXPXXXTAYKPXXHXXQPXAQEPXX

SEQ ID NO: 36536 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXPPXXXXPXXAXXAPXIXXXXXGFXLKXXXX

SEQ ID NO: 36537 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXPPXXXXPXXAXXAPXIXXXXXTPAXXXXXXX

SEQ ID NO: 36538 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXPPXXXXPXXAXXAPXIXXXXXXAPWXX

SEQ ID NO: 36539 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXPPXXXXPXXAXXAPXIXXXPPXXXXPXX

SEQ ID NO: 36540 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXPPXXXXPXXAXXAPXIXXXXXXXXXXXX

SEQ ID NO: 36541 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXPPXXXXPXXAXXAPXIXXXFXPPAPXXX

SEQ ID NO: 36542 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXPPXXXXPXXAXXAPXIXXXDFTXFPPXX

SEQ ID NO: 36543 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXPPXXXXPXXAXXAPXIXXXXTPAXFXXX

SEQ ID NO: 36544 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXPPXXXXPXXAXXAPXIXXXXARXTPXSPPXX

SEQ ID NO: 36545 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXPPXXXXPXXAXXAPXIXXXXXTAYKPXXX

SEQ ID NO: 36546 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXPPXXXXPXXAXXAPXIXXXXAXXAPXIXXXX

SEQ ID NO: 36547 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXPPXXXXPXXAXXAPXIXXXHXXQPXAQEPXX

SEQ ID NO: 36548 - protein, 32 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXPPXXXXPXHXXQPXAQEPXXXGFXLKXXXX

SEQ ID NO: 36549 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXPPXXXXPXHXXQPXAQEPXXXTPAXXXXXXX

SEQ ID NO: 36550 - protein, 29 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXPPXXXXPXHXXQPXAQEPXXXXAPWXX

SEQ ID NO: 36551 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXPPXXXXPXHXXQPXAQEPXPPXXXXPXX

SEQ ID NO: 36552 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXPPXXXXPXHXXQPXAQEPXXXXXXXXXX

SEQ ID NO: 36553 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXPPXXXXPXHXXQPXAQEPXFXPPAPXXX

SEQ ID NO: 36554 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXPPXXXXPXHXXQPXAQEPXDFTXFPPXX

SEQ ID NO: 36555 - protein, 30 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXPPXXXXPXHXXQPXAQEPXXTPAXFXXX

SEQ ID NO: 36556 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXPPXXXXPXHXXQPXAQEPXXARXTPXSPPXX

SEQ ID NO: 36557 - protein, 31 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXPPXXXXPXHXXQPXAQEPXXXTAYKPXXX

SEQ ID NO: 36558 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXPPXXXXPXHXXQPXAQEPXXAXXAPXIXXXX

SEQ ID NO: 36559 - protein, 33 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXPPXXXXPXHXXQPXAQEPXHXXQPXAQEPXX

SEQ ID NO: 36560 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXXXXXXXXXGFXLKXXXXXGFXLKXXXX

SEQ ID NO: 36561 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXXXXXXXXXGFXLKXXXXXTPAXXXXXXX

SEQ ID NO: 36562 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXXXXXXXXXGFXLKXXXXXXAPWXX

SEQ ID NO: 36563 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXXXXXXXXXGFXLKXXXPPXXXXPXX

SEQ ID NO: 36564 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXXXXXXXXXGFXLKXXXXXXXXXXXX

SEQ ID NO: 36565 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXXXXXXXXXGFXLKXXXFXPPAPXXX

SEQ ID NO: 36566 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXXXXXXXXXGFXLKXXXDFTXFPPXX

SEQ ID NO: 36567 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXXXXXXXXXGFXLKXXXXTPAXFXXX

SEQ ID NO: 36568 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXXXXXXXXXGFXLKXXXXARXTPXSPPXX

SEQ ID NO: 36569 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXXXXXXXXXGFXLKXXXXXTAYKPXXX

SEQ ID NO: 36570 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXXXXXXXXXGFXLKXXXXAXXAPXIXXXX

SEQ ID NO: 36571 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXXXXXXXXXGFXLKXXXHXXQPXAQEPXX

SEQ ID NO: 36572 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXXXXXXXXXTPAXXXXXXXXGFXLKXXXX

SEQ ID NO: 36573 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXXXXXXXXXTPAXXXXXXXXTPAXXXXXXX

SEQ ID NO: 36574 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXXXXXXXXXTPAXXXXXXXXXAPWXX

SEQ ID NO: 36575 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXXXXXXXXXTPAXXXXXXPPXXXXPXX

SEQ ID NO: 36576 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXXXXXXXXXTPAXXXXXXXXXXXXXXX

SEQ ID NO: 36577 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXXXXXXXXXTPAXXXXXXFXPPAPXXX

SEQ ID NO: 36578 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXXXXXXXXXTPAXXXXXXDFTXFPPXX

SEQ ID NO: 36579 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXXXXXXXXXTPAXXXXXXXTPAXFXXX

SEQ ID NO: 36580 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXXXXXXXXXTPAXXXXXXXARXTPXSPPXX

SEQ ID NO: 36581 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXXXXXXXXXTPAXXXXXXXXTAYKPXXX

SEQ ID NO: 36582 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXXXXXXXXXTPAXXXXXXXAXXAPXIXXXX

SEQ ID NO: 36583 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXXXXXXXXXTPAXXXXXXHXXQPXAQEPXX

SEQ ID NO: 36584 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXXXXXXXXXXXXAPWXXXGFXLKXXXX

SEQ ID NO: 36585 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXXXXXXXXXXXXAPWXXXTPAXXXXXXX

SEQ ID NO: 36586 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXXXXXXXXXXXXAPWXXXXAPWXX

SEQ ID NO: 36587 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXXXXXXXXXXXXAPWXPPXXXXPXX

SEQ ID NO: 36588 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXXXXXXXXXXXXAPWXXXXXXXXXX

SEQ ID NO: 36589 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXXXXXXXXXXXXAPWXFXPPAPXXX

SEQ ID NO: 36590 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXXXXXXXXXXXXAPWXDFTXFPPXX

SEQ ID NO: 36591 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXXXXXXXXXXXXAPWXXTPAXFXXX

SEQ ID NO: 36592 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXXXXXXXXXXXXAPWXXARXTPXSPPXX

SEQ ID NO: 36593 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXXXXXXXXXXXXAPWXXXTAYKPXXX

SEQ ID NO: 36594 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXXXXXXXXXXXXAPWXXAXXAPXIXXXX

SEQ ID NO: 36595 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXXXXXXXXXXXXAPWXHXXQPXAQEPXX

SEQ ID NO: 36596 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXXXXXXXXPPXXXXPXXXGFXLKXXXX

SEQ ID NO: 36597 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXXXXXXXXPPXXXXPXXXTPAXXXXXXX

SEQ ID NO: 36598 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXXXXXXXXPPXXXXPXXXXAPWXX

SEQ ID NO: 36599 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXXXXXXXXPPXXXXPXPPXXXXPXX

SEQ ID NO: 36600 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXXXXXXXXPPXXXXPXXXXXXXXXX

SEQ ID NO: 36601 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXXXXXXXXPPXXXXPXFXPPAPXXX

SEQ ID NO: 36602 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXXXXXXXXPPXXXXPXDFTXFPPXX

SEQ ID NO: 36603 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXXXXXXXXPPXXXXPXXTPAXFXXX

SEQ ID NO: 36604 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXXXXXXXXPPXXXXPXXARXTPXSPPXX

SEQ ID NO: 36605 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXXXXXXXXPPXXXXPXXXTAYKPXXX

SEQ ID NO: 36606 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXXXXXXXXPPXXXXPXXAXXAPXIXXXX

SEQ ID NO: 36607 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXXXXXXXXPPXXXXPXHXXQPXAQEPXX

SEQ ID NO: 36608 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXXXXXXXXXXXXXXXXXXGFXLKXXXX

SEQ ID NO: 36609 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXXXXXXXXXXXXXXXXXXTPAXXXXXXX

SEQ ID NO: 36610 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXXXXXXXXXXXXXXXXXXXAPWXX

SEQ ID NO: 36611 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXXXXXXXXXXXXXXXXPPXXXXPXX

SEQ ID NO: 36612 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXXXXXXXXXXXXXXXXXXXXXXXXX

SEQ ID NO: 36613 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXXXXXXXXXXXXXXXXFXPPAPXXX

SEQ ID NO: 36614 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXXXXXXXXXXXXXXXXDFTXFPPXX

SEQ ID NO: 36615 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXXXXXXXXXXXXXXXXXTPAXFXXX

SEQ ID NO: 36616 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXXXXXXXXXXXXXXXXXARXTPXSPPXX

SEQ ID NO: 36617 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXXXXXXXXXXXXXXXXXXTAYKPXXX

SEQ ID NO: 36618 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXXXXXXXXXXXXXXXXXAXXAPXIXXXX

SEQ ID NO: 36619 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXXXXXXXXXXXXXXXXHXXQPXAQEPXX

SEQ ID NO: 36620 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXXXXXXXXFXPPAPXXXXGFXLKXXXX

SEQ ID NO: 36621 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXXXXXXXXFXPPAPXXXXTPAXXXXXXX

SEQ ID NO: 36622 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXXXXXXXXFXPPAPXXXXXAPWXX

SEQ ID NO: 36623 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXXXXXXXXFXPPAPXXPPXXXXPXX

SEQ ID NO: 36624 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXXXXXXXXFXPPAPXXXXXXXXXXX

SEQ ID NO: 36625 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXXXXXXXXFXPPAPXXFXPPAPXXX

SEQ ID NO: 36626 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXXXXXXXXFXPPAPXXDFTXFPPXX

SEQ ID NO: 36627 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXXXXXXXXFXPPAPXXXTPAXFXXX

SEQ ID NO: 36628 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXXXXXXXXFXPPAPXXXARXTPXSPPXX

SEQ ID NO: 36629 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXXXXXXXXFXPPAPXXXXTAYKPXXX

SEQ ID NO: 36630 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXXXXXXXXFXPPAPXXXAXXAPXIXXXX

SEQ ID NO: 36631 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXXXXXXXXFXPPAPXXHXXQPXAQEPXX

SEQ ID NO: 36632 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXXXXXXXXDFTXFPPXXXGFXLKXXXX

SEQ ID NO: 36633 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXXXXXXXXDFTXFPPXXXTPAXXXXXXX

SEQ ID NO: 36634 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXXXXXXXXDFTXFPPXXXXAPWXX

SEQ ID NO: 36635 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXXXXXXXXDFTXFPPXPPXXXXPXX

SEQ ID NO: 36636 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXXXXXXXXDFTXFPPXXXXXXXXXX

SEQ ID NO: 36637 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXXXXXXXXDFTXFPPXFXPPAPXXX

SEQ ID NO: 36638 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXXXXXXXXDFTXFPPXDFTXFPPXX

SEQ ID NO: 36639 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXXXXXXXXDFTXFPPXXTPAXFXXX

SEQ ID NO: 36640 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXXXXXXXXDFTXFPPXXARXTPXSPPXX

SEQ ID NO: 36641 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXXXXXXXXDFTXFPPXXXTAYKPXXX

SEQ ID NO: 36642 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXXXXXXXXDFTXFPPXXAXXAPXIXXXX

SEQ ID NO: 36643 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXXXXXXXXDFTXFPPXHXXQPXAQEPXX

SEQ ID NO: 36644 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXXXXXXXXXTPAXFXXXXGFXLKXXXX

SEQ ID NO: 36645 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXXXXXXXXXTPAXFXXXXTPAXXXXXXX

SEQ ID NO: 36646 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXXXXXXXXXTPAXFXXXXXAPWXX

SEQ ID NO: 36647 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXXXXXXXXXTPAXFXXPPXXXXPXX

SEQ ID NO: 36648 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXXXXXXXXXTPAXFXXXXXXXXXXX

SEQ ID NO: 36649 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXXXXXXXXXTPAXFXXFXPPAPXXX

SEQ ID NO: 36650 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXXXXXXXXXTPAXFXXDFTXFPPXX

SEQ ID NO: 36651 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXXXXXXXXXTPAXFXXXTPAXFXXX

SEQ ID NO: 36652 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXXXXXXXXXTPAXFXXXARXTPXSPPXX

SEQ ID NO: 36653 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXXXXXXXXXTPAXFXXXXTAYKPXXX

SEQ ID NO: 36654 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXXXXXXXXXTPAXFXXXAXXAPXIXXXX

SEQ ID NO: 36655 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXXXXXXXXXTPAXFXXHXXQPXAQEPXX

SEQ ID NO: 36656 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXXXXXXXXARXTPXSPPXXXGFXLKXXXX

SEQ ID NO: 36657 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXXXXXXXXARXTPXSPPXXXTPAXXXXXXX

SEQ ID NO: 36658 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXXXXXXXXARXTPXSPPXXXXAPWXX

SEQ ID NO: 36659 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXXXXXXXXARXTPXSPPXPPXXXXPXX

SEQ ID NO: 36660 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXXXXXXXXARXTPXSPPXXXXXXXXXX

SEQ ID NO: 36661 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXXXXXXXXARXTPXSPPXFXPPAPXXX

SEQ ID NO: 36662 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXXXXXXXXARXTPXSPPXDFTXFPPXX

SEQ ID NO: 36663 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXXXXXXXXARXTPXSPPXXTPAXFXXX

SEQ ID NO: 36664 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXXXXXXXXARXTPXSPPXXARXTPXSPPXX

SEQ ID NO: 36665 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXXXXXXXXARXTPXSPPXXXTAYKPXXX

SEQ ID NO: 36666 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXXXXXXXXARXTPXSPPXXAXXAPXIXXXX

SEQ ID NO: 36667 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXXXXXXXXARXTPXSPPXHXXQPXAQEPXX

SEQ ID NO: 36668 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXXXXXXXXXTAYKPXXXXGFXLKXXXX

SEQ ID NO: 36669 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXXXXXXXXXTAYKPXXXXTPAXXXXXXX

SEQ ID NO: 36670 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXXXXXXXXXTAYKPXXXXXAPWXX

SEQ ID NO: 36671 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXXXXXXXXXTAYKPXXPPXXXXPXX

SEQ ID NO: 36672 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXXXXXXXXXTAYKPXXXXXXXXXXX

SEQ ID NO: 36673 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXXXXXXXXXTAYKPXXFXPPAPXXX

SEQ ID NO: 36674 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXXXXXXXXXTAYKPXXDFTXFPPXX

SEQ ID NO: 36675 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXXXXXXXXXTAYKPXXXTPAXFXXX

SEQ ID NO: 36676 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXXXXXXXXXTAYKPXXXARXTPXSPPXX

SEQ ID NO: 36677 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXXXXXXXXXTAYKPXXXXTAYKPXXX

SEQ ID NO: 36678 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXXXXXXXXXTAYKPXXXAXXAPXIXXXX

SEQ ID NO: 36679 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXXXXXXXXXTAYKPXXHXXQPXAQEPXX

SEQ ID NO: 36680 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXXXXXXXXAXXAPXIXXXXXGFXLKXXXX

SEQ ID NO: 36681 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXXXXXXXXAXXAPXIXXXXXTPAXXXXXXX

SEQ ID NO: 36682 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXXXXXXXXAXXAPXIXXXXXXAPWXX

SEQ ID NO: 36683 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXXXXXXXXAXXAPXIXXXPPXXXXPXX

SEQ ID NO: 36684 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXXXXXXXXAXXAPXIXXXXXXXXXXXX

SEQ ID NO: 36685 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXXXXXXXXAXXAPXIXXXFXPPAPXXX

SEQ ID NO: 36686 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXXXXXXXXAXXAPXIXXXDFTXFPPXX

SEQ ID NO: 36687 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXXXXXXXXAXXAPXIXXXXTPAXFXXX

SEQ ID NO: 36688 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXXXXXXXXAXXAPXIXXXXARXTPXSPPXX

SEQ ID NO: 36689 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXXXXXXXXAXXAPXIXXXXXTAYKPXXX

SEQ ID NO: 36690 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXXXXXXXXAXXAPXIXXXXAXXAPXIXXXX

SEQ ID NO: 36691 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXXXXXXXXAXXAPXIXXXHXXQPXAQEPXX

SEQ ID NO: 36692 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXXXXXXXHXXQPXAQEPXXXGFXLKXXXX

SEQ ID NO: 36693 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXXXXXXXHXXQPXAQEPXXXTPAXXXXXXX

SEQ ID NO: 36694 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXXXXXXXHXXQPXAQEPXXXXAPWXX

SEQ ID NO: 36695 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXXXXXXXHXXQPXAQEPXPPXXXXPXX

SEQ ID NO: 36696 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXXXXXXXHXXQPXAQEPXXXXXXXXXX

SEQ ID NO: 36697 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXXXXXXXHXXQPXAQEPXFXPPAPXXX

SEQ ID NO: 36698 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXXXXXXXHXXQPXAQEPXDFTXFPPXX

SEQ ID NO: 36699 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXXXXXXXHXXQPXAQEPXXTPAXFXXX

SEQ ID NO: 36700 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXXXXXXXHXXQPXAQEPXXARXTPXSPPXX

SEQ ID NO: 36701 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXXXXXXXHXXQPXAQEPXXXTAYKPXXX

SEQ ID NO: 36702 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXXXXXXXHXXQPXAQEPXXAXXAPXIXXXX

SEQ ID NO: 36703 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXXXXXXXHXXQPXAQEPXHXXQPXAQEPXX

SEQ ID NO: 36704 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXFXPPAPXXXXGFXLKXXXXXGFXLKXXXX

SEQ ID NO: 36705 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXFXPPAPXXXXGFXLKXXXXXTPAXXXXXXX

SEQ ID NO: 36706 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXFXPPAPXXXXGFXLKXXXXXXAPWXX

SEQ ID NO: 36707 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXFXPPAPXXXXGFXLKXXXPPXXXXPXX

SEQ ID NO: 36708 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXFXPPAPXXXXGFXLKXXXXXXXXXXXX

SEQ ID NO: 36709 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXFXPPAPXXXXGFXLKXXXFXPPAPXXX

SEQ ID NO: 36710 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXFXPPAPXXXXGFXLKXXXDFTXFPPXX

SEQ ID NO: 36711 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXFXPPAPXXXXGFXLKXXXXTPAXFXXX

SEQ ID NO: 36712 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXFXPPAPXXXXGFXLKXXXXARXTPXSPPXX

SEQ ID NO: 36713 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXFXPPAPXXXXGFXLKXXXXXTAYKPXXX

SEQ ID NO: 36714 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXFXPPAPXXXXGFXLKXXXXAXXAPXIXXXX

SEQ ID NO: 36715 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXFXPPAPXXXXGFXLKXXXHXXQPXAQEPXX

SEQ ID NO: 36716 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXFXPPAPXXXXTPAXXXXXXXXGFXLKXXXX

SEQ ID NO: 36717 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXFXPPAPXXXXTPAXXXXXXXXTPAXXXXXXX

SEQ ID NO: 36718 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXFXPPAPXXXXTPAXXXXXXXXXAPWXX

SEQ ID NO: 36719 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXFXPPAPXXXXTPAXXXXXXPPXXXXPXX

SEQ ID NO: 36720 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXFXPPAPXXXXTPAXXXXXXXXXXXXXXX

SEQ ID NO: 36721 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXFXPPAPXXXXTPAXXXXXXFXPPAPXXX

SEQ ID NO: 36722 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXFXPPAPXXXXTPAXXXXXXDFTXFPPXX

SEQ ID NO: 36723 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXFXPPAPXXXXTPAXXXXXXXTPAXFXXX

SEQ ID NO: 36724 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXFXPPAPXXXXTPAXXXXXXXARXTPXSPPXX

SEQ ID NO: 36725 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXFXPPAPXXXXTPAXXXXXXXXTAYKPXXX

SEQ ID NO: 36726 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXFXPPAPXXXXTPAXXXXXXXAXXAPXIXXXX

SEQ ID NO: 36727 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXFXPPAPXXXXTPAXXXXXXHXXQPXAQEPXX

SEQ ID NO: 36728 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXFXPPAPXXXXXAPWXXXGFXLKXXXX

SEQ ID NO: 36729 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXFXPPAPXXXXXAPWXXXTPAXXXXXXX

SEQ ID NO: 36730 - protein, 25 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXFXPPAPXXXXXAPWXXXXAPWXX

SEQ ID NO: 36731 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXFXPPAPXXXXXAPWXPPXXXXPXX

SEQ ID NO: 36732 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXFXPPAPXXXXXAPWXXXXXXXXXX

SEQ ID NO: 36733 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXFXPPAPXXXXXAPWXFXPPAPXXX

SEQ ID NO: 36734 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXFXPPAPXXXXXAPWXDFTXFPPXX

SEQ ID NO: 36735 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXFXPPAPXXXXXAPWXXTPAXFXXX

SEQ ID NO: 36736 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXFXPPAPXXXXXAPWXXARXTPXSPPXX

SEQ ID NO: 36737 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXFXPPAPXXXXXAPWXXXTAYKPXXX

SEQ ID NO: 36738 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXFXPPAPXXXXXAPWXXAXXAPXIXXXX

SEQ ID NO: 36739 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXFXPPAPXXXXXAPWXHXXQPXAQEPXX

SEQ ID NO: 36740 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXFXPPAPXXPPXXXXPXXXGFXLKXXXX

SEQ ID NO: 36741 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXFXPPAPXXPPXXXXPXXXTPAXXXXXXX

SEQ ID NO: 36742 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXFXPPAPXXPPXXXXPXXXXAPWXX

SEQ ID NO: 36743 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXFXPPAPXXPPXXXXPXPPXXXXPXX

SEQ ID NO: 36744 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXFXPPAPXXPPXXXXPXXXXXXXXXX

SEQ ID NO: 36745 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXFXPPAPXXPPXXXXPXFXPPAPXXX

SEQ ID NO: 36746 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXFXPPAPXXPPXXXXPXDFTXFPPXX

SEQ ID NO: 36747 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXFXPPAPXXPPXXXXPXXTPAXFXXX

SEQ ID NO: 36748 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXFXPPAPXXPPXXXXPXXARXTPXSPPXX

SEQ ID NO: 36749 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXFXPPAPXXPPXXXXPXXXTAYKPXXX

SEQ ID NO: 36750 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXFXPPAPXXPPXXXXPXXAXXAPXIXXXX

SEQ ID NO: 36751 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXFXPPAPXXPPXXXXPXHXXQPXAQEPXX

SEQ ID NO: 36752 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXFXPPAPXXXXXXXXXXXXGFXLKXXXX

SEQ ID NO: 36753 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXFXPPAPXXXXXXXXXXXXTPAXXXXXXX

SEQ ID NO: 36754 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXFXPPAPXXXXXXXXXXXXXAPWXX

SEQ ID NO: 36755 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXFXPPAPXXXXXXXXXXPPXXXXPXX

SEQ ID NO: 36756 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXFXPPAPXXXXXXXXXXXXXXXXXXX

SEQ ID NO: 36757 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXFXPPAPXXXXXXXXXXFXPPAPXXX

SEQ ID NO: 36758 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXFXPPAPXXXXXXXXXXDFTXFPPXX

SEQ ID NO: 36759 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXFXPPAPXXXXXXXXXXXTPAXFXXX

SEQ ID NO: 36760 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXFXPPAPXXXXXXXXXXXARXTPXSPPXX

SEQ ID NO: 36761 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXFXPPAPXXXXXXXXXXXXTAYKPXXX

SEQ ID NO: 36762 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXFXPPAPXXXXXXXXXXXAXXAPXIXXXX

SEQ ID NO: 36763 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXFXPPAPXXXXXXXXXXHXXQPXAQEPXX

SEQ ID NO: 36764 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXFXPPAPXXFXPPAPXXXXGFXLKXXXX

SEQ ID NO: 36765 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXFXPPAPXXFXPPAPXXXXTPAXXXXXXX

SEQ ID NO: 36766 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXFXPPAPXXFXPPAPXXXXXAPWXX

SEQ ID NO: 36767 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXFXPPAPXXFXPPAPXXPPXXXXPXX

SEQ ID NO: 36768 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXFXPPAPXXFXPPAPXXXXXXXXXXX

SEQ ID NO: 36769 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXFXPPAPXXFXPPAPXXFXPPAPXXX

SEQ ID NO: 36770 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXFXPPAPXXFXPPAPXXDFTXFPPXX

SEQ ID NO: 36771 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXFXPPAPXXFXPPAPXXXTPAXFXXX

SEQ ID NO: 36772 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXFXPPAPXXFXPPAPXXXARXTPXSPPXX

SEQ ID NO: 36773 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXFXPPAPXXFXPPAPXXXXTAYKPXXX

SEQ ID NO: 36774 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXFXPPAPXXFXPPAPXXXAXXAPXIXXXX

SEQ ID NO: 36775 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXFXPPAPXXFXPPAPXXHXXQPXAQEPXX

SEQ ID NO: 36776 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXFXPPAPXXDFTXFPPXXXGFXLKXXXX

SEQ ID NO: 36777 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXFXPPAPXXDFTXFPPXXXTPAXXXXXXX

SEQ ID NO: 36778 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXFXPPAPXXDFTXFPPXXXXAPWXX

SEQ ID NO: 36779 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXFXPPAPXXDFTXFPPXPPXXXXPXX

SEQ ID NO: 36780 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXFXPPAPXXDFTXFPPXXXXXXXXXX

SEQ ID NO: 36781 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXFXPPAPXXDFTXFPPXFXPPAPXXX

SEQ ID NO: 36782 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXFXPPAPXXDFTXFPPXDFTXFPPXX

SEQ ID NO: 36783 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXFXPPAPXXDFTXFPPXXTPAXFXXX

SEQ ID NO: 36784 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXFXPPAPXXDFTXFPPXXARXTPXSPPXX

SEQ ID NO: 36785 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXFXPPAPXXDFTXFPPXXXTAYKPXXX

SEQ ID NO: 36786 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXFXPPAPXXDFTXFPPXXAXXAPXIXXXX

SEQ ID NO: 36787 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXFXPPAPXXDFTXFPPXHXXQPXAQEPXX

SEQ ID NO: 36788 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXFXPPAPXXXTPAXFXXXXGFXLKXXXX

SEQ ID NO: 36789 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXFXPPAPXXXTPAXFXXXXTPAXXXXXXX

SEQ ID NO: 36790 - protein, 26 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXFXPPAPXXXTPAXFXXXXXAPWXX

SEQ ID NO: 36791 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXFXPPAPXXXTPAXFXXPPXXXXPXX

SEQ ID NO: 36792 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXFXPPAPXXXTPAXFXXXXXXXXXXX

SEQ ID NO: 36793 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXFXPPAPXXXTPAXFXXFXPPAPXXX

SEQ ID NO: 36794 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXFXPPAPXXXTPAXFXXDFTXFPPXX

SEQ ID NO: 36795 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXFXPPAPXXXTPAXFXXXTPAXFXXX

SEQ ID NO: 36796 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXFXPPAPXXXTPAXFXXXARXTPXSPPXX

SEQ ID NO: 36797 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXFXPPAPXXXTPAXFXXXXTAYKPXXX

SEQ ID NO: 36798 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXFXPPAPXXXTPAXFXXXAXXAPXIXXXX

SEQ ID NO: 36799 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXFXPPAPXXXTPAXFXXHXXQPXAQEPXX

SEQ ID NO: 36800 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXFXPPAPXXXARXTPXSPPXXXGFXLKXXXX

SEQ ID NO: 36801 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXFXPPAPXXXARXTPXSPPXXXTPAXXXXXXX

SEQ ID NO: 36802 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXFXPPAPXXXARXTPXSPPXXXXAPWXX

SEQ ID NO: 36803 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXFXPPAPXXXARXTPXSPPXPPXXXXPXX

SEQ ID NO: 36804 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXFXPPAPXXXARXTPXSPPXXXXXXXXXX

SEQ ID NO: 36805 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXFXPPAPXXXARXTPXSPPXFXPPAPXXX

SEQ ID NO: 36806 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXFXPPAPXXXARXTPXSPPXDFTXFPPXX

SEQ ID NO: 36807 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXFXPPAPXXXARXTPXSPPXXTPAXFXXX

SEQ ID NO: 36808 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXFXPPAPXXXARXTPXSPPXXARXTPXSPPXX

SEQ ID NO: 36809 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXFXPPAPXXXARXTPXSPPXXXTAYKPXXX

SEQ ID NO: 36810 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXFXPPAPXXXARXTPXSPPXXAXXAPXIXXXX

SEQ ID NO: 36811 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXFXPPAPXXXARXTPXSPPXHXXQPXAQEPXX

SEQ ID NO: 36812 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXFXPPAPXXXXTAYKPXXXXGFXLKXXXX

SEQ ID NO: 36813 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXFXPPAPXXXXTAYKPXXXXTPAXXXXXXX

SEQ ID NO: 36814 - protein, 27 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXFXPPAPXXXXTAYKPXXXXXAPWXX

SEQ ID NO: 36815 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXFXPPAPXXXXTAYKPXXPPXXXXPXX

SEQ ID NO: 36816 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXFXPPAPXXXXTAYKPXXXXXXXXXXX

SEQ ID NO: 36817 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXFXPPAPXXXXTAYKPXXFXPPAPXXX

SEQ ID NO: 36818 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXFXPPAPXXXXTAYKPXXDFTXFPPXX

SEQ ID NO: 36819 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXFXPPAPXXXXTAYKPXXXTPAXFXXX

SEQ ID NO: 36820 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXFXPPAPXXXXTAYKPXXXARXTPXSPPXX

SEQ ID NO: 36821 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXFXPPAPXXXXTAYKPXXXXTAYKPXXX

SEQ ID NO: 36822 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXFXPPAPXXXXTAYKPXXXAXXAPXIXXXX

SEQ ID NO: 36823 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXFXPPAPXXXXTAYKPXXHXXQPXAQEPXX

SEQ ID NO: 36824 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXFXPPAPXXXAXXAPXIXXXXXGFXLKXXXX

SEQ ID NO: 36825 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXFXPPAPXXXAXXAPXIXXXXXTPAXXXXXXX

SEQ ID NO: 36826 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXFXPPAPXXXAXXAPXIXXXXXXAPWXX

SEQ ID NO: 36827 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXFXPPAPXXXAXXAPXIXXXPPXXXXPXX

SEQ ID NO: 36828 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXFXPPAPXXXAXXAPXIXXXXXXXXXXXX

SEQ ID NO: 36829 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXFXPPAPXXXAXXAPXIXXXFXPPAPXXX

SEQ ID NO: 36830 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXFXPPAPXXXAXXAPXIXXXDFTXFPPXX

SEQ ID NO: 36831 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXFXPPAPXXXAXXAPXIXXXXTPAXFXXX

SEQ ID NO: 36832 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXFXPPAPXXXAXXAPXIXXXXARXTPXSPPXX

SEQ ID NO: 36833 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXFXPPAPXXXAXXAPXIXXXXXTAYKPXXX

SEQ ID NO: 36834 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXFXPPAPXXXAXXAPXIXXXXAXXAPXIXXXX

SEQ ID NO: 36835 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXFXPPAPXXXAXXAPXIXXXHXXQPXAQEPXX

SEQ ID NO: 36836 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXFXPPAPXXHXXQPXAQEPXXXGFXLKXXXX

SEQ ID NO: 36837 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXFXPPAPXXHXXQPXAQEPXXXTPAXXXXXXX

SEQ ID NO: 36838 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXFXPPAPXXHXXQPXAQEPXXXXAPWXX

SEQ ID NO: 36839 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXFXPPAPXXHXXQPXAQEPXPPXXXXPXX

SEQ ID NO: 36840 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXFXPPAPXXHXXQPXAQEPXXXXXXXXXX

SEQ ID NO: 36841 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXFXPPAPXXHXXQPXAQEPXFXPPAPXXX

SEQ ID NO: 36842 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXFXPPAPXXHXXQPXAQEPXDFTXFPPXX

SEQ ID NO: 36843 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXFXPPAPXXHXXQPXAQEPXXTPAXFXXX

SEQ ID NO: 36844 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXFXPPAPXXHXXQPXAQEPXXARXTPXSPPXX

SEQ ID NO: 36845 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXFXPPAPXXHXXQPXAQEPXXXTAYKPXXX

SEQ ID NO: 36846 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXFXPPAPXXHXXQPXAQEPXXAXXAPXIXXXX

SEQ ID NO: 36847 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXFXPPAPXXHXXQPXAQEPXHXXQPXAQEPXX

SEQ ID NO: 36848 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXDFTXFPPXXXGFXLKXXXXXGFXLKXXXX

SEQ ID NO: 36849 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXDFTXFPPXXXGFXLKXXXXXTPAXXXXXXX

SEQ ID NO: 36850 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXDFTXFPPXXXGFXLKXXXXXXAPWXX

SEQ ID NO: 36851 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXDFTXFPPXXXGFXLKXXXPPXXXXPXX

SEQ ID NO: 36852 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXDFTXFPPXXXGFXLKXXXXXXXXXXXX

SEQ ID NO: 36853 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXDFTXFPPXXXGFXLKXXXFXPPAPXXX

SEQ ID NO: 36854 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXDFTXFPPXXXGFXLKXXXDFTXFPPXX

SEQ ID NO: 36855 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXDFTXFPPXXXGFXLKXXXXTPAXFXXX

SEQ ID NO: 36856 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXDFTXFPPXXXGFXLKXXXXARXTPXSPPXX

SEQ ID NO: 36857 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXDFTXFPPXXXGFXLKXXXXXTAYKPXXX

SEQ ID NO: 36858 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXDFTXFPPXXXGFXLKXXXXAXXAPXIXXXX

SEQ ID NO: 36859 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXDFTXFPPXXXGFXLKXXXHXXQPXAQEPXX

SEQ ID NO: 36860 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXDFTXFPPXXXTPAXXXXXXXXGFXLKXXXX

SEQ ID NO: 36861 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXDFTXFPPXXXTPAXXXXXXXXTPAXXXXXXX

SEQ ID NO: 36862 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXDFTXFPPXXXTPAXXXXXXXXXAPWXX

SEQ ID NO: 36863 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXDFTXFPPXXXTPAXXXXXXPPXXXXPXX

SEQ ID NO: 36864 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXDFTXFPPXXXTPAXXXXXXXXXXXXXXX

SEQ ID NO: 36865 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXDFTXFPPXXXTPAXXXXXXFXPPAPXXX

SEQ ID NO: 36866 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXDFTXFPPXXXTPAXXXXXXDFTXFPPXX

SEQ ID NO: 36867 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXDFTXFPPXXXTPAXXXXXXXTPAXFXXX

SEQ ID NO: 36868 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXDFTXFPPXXXTPAXXXXXXXARXTPXSPPXX

SEQ ID NO: 36869 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXDFTXFPPXXXTPAXXXXXXXXTAYKPXXX

SEQ ID NO: 36870 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXDFTXFPPXXXTPAXXXXXXXAXXAPXIXXXX

SEQ ID NO: 36871 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXDFTXFPPXXXTPAXXXXXXHXXQPXAQEPXX

SEQ ID NO: 36872 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXDFTXFPPXXXXAPWXXXGFXLKXXXX

SEQ ID NO: 36873 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXDFTXFPPXXXXAPWXXXTPAXXXXXXX

SEQ ID NO: 36874 - protein, 25 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXDFTXFPPXXXXAPWXXXXAPWXX

SEQ ID NO: 36875 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXDFTXFPPXXXXAPWXPPXXXXPXX

SEQ ID NO: 36876 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXDFTXFPPXXXXAPWXXXXXXXXXX

SEQ ID NO: 36877 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXDFTXFPPXXXXAPWXFXPPAPXXX

SEQ ID NO: 36878 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXDFTXFPPXXXXAPWXDFTXFPPXX

SEQ ID NO: 36879 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXDFTXFPPXXXXAPWXXTPAXFXXX

SEQ ID NO: 36880 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXDFTXFPPXXXXAPWXXARXTPXSPPXX

SEQ ID NO: 36881 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXDFTXFPPXXXXAPWXXXTAYKPXXX

SEQ ID NO: 36882 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXDFTXFPPXXXXAPWXXAXXAPXIXXXX

SEQ ID NO: 36883 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXDFTXFPPXXXXAPWXHXXQPXAQEPXX

SEQ ID NO: 36884 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXDFTXFPPXPPXXXXPXXXGFXLKXXXX

SEQ ID NO: 36885 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXDFTXFPPXPPXXXXPXXXTPAXXXXXXX

SEQ ID NO: 36886 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXDFTXFPPXPPXXXXPXXXXAPWXX

SEQ ID NO: 36887 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXDFTXFPPXPPXXXXPXPPXXXXPXX

SEQ ID NO: 36888 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXDFTXFPPXPPXXXXPXXXXXXXXXX

SEQ ID NO: 36889 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXDFTXFPPXPPXXXXPXFXPPAPXXX

SEQ ID NO: 36890 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXDFTXFPPXPPXXXXPXDFTXFPPXX

SEQ ID NO: 36891 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXDFTXFPPXPPXXXXPXXTPAXFXXX

SEQ ID NO: 36892 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXDFTXFPPXPPXXXXPXXARXTPXSPPXX

SEQ ID NO: 36893 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXDFTXFPPXPPXXXXPXXXTAYKPXXX

SEQ ID NO: 36894 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXDFTXFPPXPPXXXXPXXAXXAPXIXXXX

SEQ ID NO: 36895 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXDFTXFPPXPPXXXXPXHXXQPXAQEPXX

SEQ ID NO: 36896 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXDFTXFPPXXXXXXXXXXXGFXLKXXXX

SEQ ID NO: 36897 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXDFTXFPPXXXXXXXXXXXTPAXXXXXXX

SEQ ID NO: 36898 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXDFTXFPPXXXXXXXXXXXXAPWXX

SEQ ID NO: 36899 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXDFTXFPPXXXXXXXXXPPXXXXPXX

SEQ ID NO: 36900 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXDFTXFPPXXXXXXXXXXXXXXXXXX

SEQ ID NO: 36901 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXDFTXFPPXXXXXXXXXFXPPAPXXX

SEQ ID NO: 36902 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXDFTXFPPXXXXXXXXXDFTXFPPXX

SEQ ID NO: 36903 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXDFTXFPPXXXXXXXXXXTPAXFXXX

SEQ ID NO: 36904 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXDFTXFPPXXXXXXXXXXARXTPXSPPXX

SEQ ID NO: 36905 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXDFTXFPPXXXXXXXXXXXTAYKPXXX

SEQ ID NO: 36906 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXDFTXFPPXXXXXXXXXXAXXAPXIXXXX

SEQ ID NO: 36907 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXDFTXFPPXXXXXXXXXHXXQPXAQEPXX

SEQ ID NO: 36908 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXDFTXFPPXFXPPAPXXXXGFXLKXXXX

SEQ ID NO: 36909 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXDFTXFPPXFXPPAPXXXXTPAXXXXXXX

SEQ ID NO: 36910 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXDFTXFPPXFXPPAPXXXXXAPWXX

SEQ ID NO: 36911 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXDFTXFPPXFXPPAPXXPPXXXXPXX

SEQ ID NO: 36912 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXDFTXFPPXFXPPAPXXXXXXXXXXX

SEQ ID NO: 36913 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXDFTXFPPXFXPPAPXXFXPPAPXXX

SEQ ID NO: 36914 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXDFTXFPPXFXPPAPXXDFTXFPPXX

SEQ ID NO: 36915 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXDFTXFPPXFXPPAPXXXTPAXFXXX

SEQ ID NO: 36916 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXDFTXFPPXFXPPAPXXXARXTPXSPPXX

SEQ ID NO: 36917 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXDFTXFPPXFXPPAPXXXXTAYKPXXX

SEQ ID NO: 36918 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXDFTXFPPXFXPPAPXXXAXXAPXIXXXX

SEQ ID NO: 36919 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXDFTXFPPXFXPPAPXXHXXQPXAQEPXX

SEQ ID NO: 36920 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXDFTXFPPXDFTXFPPXXXGFXLKXXXX

SEQ ID NO: 36921 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXDFTXFPPXDFTXFPPXXXTPAXXXXXXX

SEQ ID NO: 36922 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXDFTXFPPXDFTXFPPXXXXAPWXX

SEQ ID NO: 36923 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXDFTXFPPXDFTXFPPXPPXXXXPXX

SEQ ID NO: 36924 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXDFTXFPPXDFTXFPPXXXXXXXXXX

SEQ ID NO: 36925 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXDFTXFPPXDFTXFPPXFXPPAPXXX

SEQ ID NO: 36926 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXDFTXFPPXDFTXFPPXDFTXFPPXX

SEQ ID NO: 36927 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXDFTXFPPXDFTXFPPXXTPAXFXXX

SEQ ID NO: 36928 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXDFTXFPPXDFTXFPPXXARXTPXSPPXX

SEQ ID NO: 36929 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXDFTXFPPXDFTXFPPXXXTAYKPXXX

SEQ ID NO: 36930 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXDFTXFPPXDFTXFPPXXAXXAPXIXXXX

SEQ ID NO: 36931 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXDFTXFPPXDFTXFPPXHXXQPXAQEPXX

SEQ ID NO: 36932 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXDFTXFPPXXTPAXFXXXXGFXLKXXXX

SEQ ID NO: 36933 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXDFTXFPPXXTPAXFXXXXTPAXXXXXXX

SEQ ID NO: 36934 - protein, 26 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXDFTXFPPXXTPAXFXXXXXAPWXX

SEQ ID NO: 36935 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXDFTXFPPXXTPAXFXXPPXXXXPXX

SEQ ID NO: 36936 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXDFTXFPPXXTPAXFXXXXXXXXXXX

SEQ ID NO: 36937 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXDFTXFPPXXTPAXFXXFXPPAPXXX

SEQ ID NO: 36938 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXDFTXFPPXXTPAXFXXDFTXFPPXX

SEQ ID NO: 36939 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXDFTXFPPXXTPAXFXXXTPAXFXXX

SEQ ID NO: 36940 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXDFTXFPPXXTPAXFXXXARXTPXSPPXX

SEQ ID NO: 36941 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXDFTXFPPXXTPAXFXXXXTAYKPXXX

SEQ ID NO: 36942 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXDFTXFPPXXTPAXFXXXAXXAPXIXXXX

SEQ ID NO: 36943 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXDFTXFPPXXTPAXFXXHXXQPXAQEPXX

SEQ ID NO: 36944 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXDFTXFPPXXARXTPXSPPXXXGFXLKXXXX

SEQ ID NO: 36945 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXDFTXFPPXXARXTPXSPPXXXTPAXXXXXXX

SEQ ID NO: 36946 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXDFTXFPPXXARXTPXSPPXXXXAPWXX

SEQ ID NO: 36947 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXDFTXFPPXXARXTPXSPPXPPXXXXPXX

SEQ ID NO: 36948 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXDFTXFPPXXARXTPXSPPXXXXXXXXXX

SEQ ID NO: 36949 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXDFTXFPPXXARXTPXSPPXFXPPAPXXX

SEQ ID NO: 36950 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXDFTXFPPXXARXTPXSPPXDFTXFPPXX

SEQ ID NO: 36951 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXDFTXFPPXXARXTPXSPPXXTPAXFXXX

SEQ ID NO: 36952 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXDFTXFPPXXARXTPXSPPXXARXTPXSPPXX

SEQ ID NO: 36953 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXDFTXFPPXXARXTPXSPPXXXTAYKPXXX

SEQ ID NO: 36954 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXDFTXFPPXXARXTPXSPPXXAXXAPXIXXXX

SEQ ID NO: 36955 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXDFTXFPPXXARXTPXSPPXHXXQPXAQEPXX

SEQ ID NO: 36956 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXDFTXFPPXXXTAYKPXXXXGFXLKXXXX

SEQ ID NO: 36957 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXDFTXFPPXXXTAYKPXXXXTPAXXXXXXX

SEQ ID NO: 36958 - protein, 27 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXDFTXFPPXXXTAYKPXXXXXAPWXX

SEQ ID NO: 36959 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXDFTXFPPXXXTAYKPXXPPXXXXPXX

SEQ ID NO: 36960 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXDFTXFPPXXXTAYKPXXXXXXXXXXX

SEQ ID NO: 36961 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXDFTXFPPXXXTAYKPXXFXPPAPXXX

SEQ ID NO: 36962 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXDFTXFPPXXXTAYKPXXDFTXFPPXX

SEQ ID NO: 36963 - protein, 28 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXDFTXFPPXXXTAYKPXXXTPAXFXXX

SEQ ID NO: 36964 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXDFTXFPPXXXTAYKPXXXARXTPXSPPXX

SEQ ID NO: 36965 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXDFTXFPPXXXTAYKPXXXXTAYKPXXX

SEQ ID NO: 36966 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXDFTXFPPXXXTAYKPXXXAXXAPXIXXXX

SEQ ID NO: 36967 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXDFTXFPPXXXTAYKPXXHXXQPXAQEPXX

SEQ ID NO: 36968 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXDFTXFPPXXAXXAPXIXXXXXGFXLKXXXX

SEQ ID NO: 36969 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXDFTXFPPXXAXXAPXIXXXXXTPAXXXXXXX

SEQ ID NO: 36970 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXDFTXFPPXXAXXAPXIXXXXXXAPWXX

SEQ ID NO: 36971 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXDFTXFPPXXAXXAPXIXXXPPXXXXPXX

SEQ ID NO: 36972 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXDFTXFPPXXAXXAPXIXXXXXXXXXXXX

SEQ ID NO: 36973 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXDFTXFPPXXAXXAPXIXXXFXPPAPXXX

SEQ ID NO: 36974 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXDFTXFPPXXAXXAPXIXXXDFTXFPPXX

SEQ ID NO: 36975 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXDFTXFPPXXAXXAPXIXXXXTPAXFXXX

SEQ ID NO: 36976 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXDFTXFPPXXAXXAPXIXXXXARXTPXSPPXX

SEQ ID NO: 36977 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXDFTXFPPXXAXXAPXIXXXXXTAYKPXXX

SEQ ID NO: 36978 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXDFTXFPPXXAXXAPXIXXXXAXXAPXIXXXX

SEQ ID NO: 36979 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXDFTXFPPXXAXXAPXIXXXHXXQPXAQEPXX

SEQ ID NO: 36980 - protein, 32 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXDFTXFPPXHXXQPXAQEPXXXGFXLKXXXX

SEQ ID NO: 36981 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXDFTXFPPXHXXQPXAQEPXXXTPAXXXXXXX

SEQ ID NO: 36982 - protein, 29 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXDFTXFPPXHXXQPXAQEPXXXXAPWXX

SEQ ID NO: 36983 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXDFTXFPPXHXXQPXAQEPXPPXXXXPXX

SEQ ID NO: 36984 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXDFTXFPPXHXXQPXAQEPXXXXXXXXXX

SEQ ID NO: 36985 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXDFTXFPPXHXXQPXAQEPXFXPPAPXXX

SEQ ID NO: 36986 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXDFTXFPPXHXXQPXAQEPXDFTXFPPXX

SEQ ID NO: 36987 - protein, 30 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXDFTXFPPXHXXQPXAQEPXXTPAXFXXX

SEQ ID NO: 36988 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXDFTXFPPXHXXQPXAQEPXXARXTPXSPPXX

SEQ ID NO: 36989 - protein, 31 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXDFTXFPPXHXXQPXAQEPXXXTAYKPXXX

SEQ ID NO: 36990 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXDFTXFPPXHXXQPXAQEPXXAXXAPXIXXXX

SEQ ID NO: 36991 - protein, 33 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXDFTXFPPXHXXQPXAQEPXHXXQPXAQEPXX

SEQ ID NO: 36992 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXTPAXFXXXXGFXLKXXXXXGFXLKXXXX

SEQ ID NO: 36993 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXTPAXFXXXXGFXLKXXXXXTPAXXXXXXX

SEQ ID NO: 36994 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXTPAXFXXXXGFXLKXXXXXXAPWXX

SEQ ID NO: 36995 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXTPAXFXXXXGFXLKXXXPPXXXXPXX

SEQ ID NO: 36996 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXTPAXFXXXXGFXLKXXXXXXXXXXXX

SEQ ID NO: 36997 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXTPAXFXXXXGFXLKXXXFXPPAPXXX

SEQ ID NO: 36998 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXTPAXFXXXXGFXLKXXXDFTXFPPXX

SEQ ID NO: 36999 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXTPAXFXXXXGFXLKXXXXTPAXFXXX

SEQ ID NO: 37000 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXTPAXFXXXXGFXLKXXXXARXTPXSPPXX

SEQ ID NO: 37001 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXTPAXFXXXXGFXLKXXXXXTAYKPXXX

SEQ ID NO: 37002 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXTPAXFXXXXGFXLKXXXXAXXAPXIXXXX

SEQ ID NO: 37003 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (15)..(15): Xaa = any amino acid, non amino acid, or is absent
  MISC_FEATURE (18)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXTPAXFXXXXGFXLKXXXHXXQPXAQEPXX

SEQ ID NO: 37004 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXTPAXFXXXXTPAXXXXXXXXGFXLKXXXX

SEQ ID NO: 37005 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXTPAXFXXXXTPAXXXXXXXXTPAXXXXXXX

SEQ ID NO: 37006 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXTPAXFXXXXTPAXXXXXXXXXAPWXX

SEQ ID NO: 37007 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXTPAXFXXXXTPAXXXXXXPPXXXXPXX

SEQ ID NO: 37008 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXTPAXFXXXXTPAXXXXXXXXXXXXXXX

SEQ ID NO: 37009 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXTPAXFXXXXTPAXXXXXXFXPPAPXXX

SEQ ID NO: 37010 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXTPAXFXXXXTPAXXXXXXDFTXFPPXX

SEQ ID NO: 37011 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXTPAXFXXXXTPAXXXXXXXTPAXFXXX

SEQ ID NO: 37012 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXTPAXFXXXXTPAXXXXXXXARXTPXSPPXX

SEQ ID NO: 37013 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXTPAXFXXXXTPAXXXXXXXXTAYKPXXX

SEQ ID NO: 37014 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXTPAXFXXXXTPAXXXXXXXAXXAPXIXXXX

SEQ ID NO: 37015 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(12): Xaa = any amino acid, non amino acid, or is absent
  MISC_FEATURE (16)..(16): Xaa = Asn or Asp
  MISC_FEATURE (17)..(17): Xaa = Asn or Glu
  MISC_FEATURE (18)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXTPAXFXXXXTPAXXXXXXHXXQPXAQEPXX

SEQ ID NO: 37016 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (22)..(22): Xaa = any amino acid, non amino acid, or is absent
  MISC_FEATURE (25)..(28): Xaa = any amino acid, non amino acid, or is absent
XXXTPAXFXXXXXAPWXXXGFXLKXXXX

SEQ ID NO: 37017 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(19): Xaa = any amino acid, non amino acid, or is absent
  MISC_FEATURE (23)..(23): Xaa = Asn or Asp
  MISC_FEATURE (24)..(24): Xaa = Asn or Glu
  MISC_FEATURE (25)..(29): Xaa = any amino acid, non amino acid, or is absent
XXXTPAXFXXXXXAPWXXXTPAXXXXXXX

SEQ ID NO: 37018 - protein, 25 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Ile, Phe, Trp, Tyr or Ala
  MISC_FEATURE (19)..(19): Xaa = Asp, Ala, Gln, Glu, Gly, His, Ile, Leu, Phe, Pro, Thr or Tyr
  MISC_FEATURE (20)..(20): Xaa = Gln, Leu, Trp or Tyr
  MISC_FEATURE (24)..(25): Xaa = any amino acid, non amino acid, or is absent
XXXTPAXFXXXXXAPWXXXXAPWXX

SEQ ID NO: 37019 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (20)..(20): Xaa = Tyr or Pro
  MISC_FEATURE (21)..(21): Xaa = Trp, Tyr, Phe, Ala, Val, Cys, Thr, Leu, Ser, His, Gln, Glu, Gly or Ile
  MISC_FEATURE (22)..(22): Xaa = Trp, Ile, Phe, Pro, Asp, Gly, Cys or Ala
  MISC_FEATURE (23)..(23): Xaa = Gly or Asn
  MISC_FEATURE (25)..(26): Xaa = any amino acid, non amino acid, or is absent
XXXTPAXFXXXXXAPWXPPXXXXPXX

SEQ ID NO: 37020 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Gly, Tyr or Trp
  MISC_FEATURE (19)..(19): Xaa = Trp, Val, Ile, Phe, Arg, Met, Ser or Leu
  MISC_FEATURE (20)..(20): Xaa = Ile or Gly
  MISC_FEATURE (21)..(21): Xaa = Tyr, Pro, His, Leu or Phe
  MISC_FEATURE (22)..(22): Xaa = Ile, Asp, Tyr, Phe, Val, Thr, Gly, Ala or Gln
  MISC_FEATURE (23)..(23): Xaa = Phe, Arg, Cys, Leu, Ala, Gln, Asp or Val
  MISC_FEATURE (24)..(24): Xaa = Phe or Tyr
  MISC_FEATURE (25)..(26): Xaa = any amino acid, non amino acid, or is absent
XXXTPAXFXXXXXAPWXXXXXXXXXX

SEQ ID NO: 37021 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Pro or Ser
  MISC_FEATURE (24)..(24): Xaa = Pro, Tyr, Leu, Ala, Glu, Gly, Val or Ile
  MISC_FEATURE (25)..(26): Xaa = any amino acid, non amino acid, or is absent
XXXTPAXFXXXXXAPWXFXPPAPXXX

SEQ ID NO: 37022 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (21)..(21): Xaa = Val or Ile
  MISC_FEATURE (25)..(26): Xaa = any amino acid, non amino acid, or is absent
XXXTPAXFXXXXXAPWXDFTXFPPXX

SEQ ID NO: 37023 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Tyr, Thr or His
  MISC_FEATURE (22)..(22): Xaa = His or Ile
  MISC_FEATURE (24)..(24): Xaa = Tyr or Ala
  MISC_FEATURE (25)..(26): Xaa = any amino acid, non amino acid, or is absent
XXXTPAXFXXXXXAPWXXTPAXFXXX

SEQ ID NO: 37024 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Pro or Ala
  MISC_FEATURE (21)..(21): Xaa = Ala, Pro, Trp, Asn or Leu
  MISC_FEATURE (24)..(24): Xaa = Pro or Phe
  MISC_FEATURE (28)..(29): Xaa = any amino acid, non amino acid, or is absent
XXXTPAXFXXXXXAPWXXARXTPXSPPXX

SEQ ID NO: 37025 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Trp or Leu
  MISC_FEATURE (19)..(19): Xaa = Ala, Asn, Ser, Trp or Glu
  MISC_FEATURE (25)..(25): Xaa = Ser or Phe
  MISC_FEATURE (26)..(27): Xaa = any amino acid, non amino acid, or is absent
XXXTPAXFXXXXXAPWXXXTAYKPXXX

SEQ ID NO: 37026 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (18)..(18): Xaa = Asn, Trp or Ala
  MISC_FEATURE (20)..(20): Xaa = Phe, Asn, Tyr or Pro
  MISC_FEATURE (21)..(21): Xaa = Pro, His, Tyr, Trp or Ala
  MISC_FEATURE (24)..(24): Xaa = Tyr or Ala
  MISC_FEATURE (26)..(26): Xaa = Trp or Gln
  MISC_FEATURE (27)..(27): Xaa = Arg or Gln
  MISC_FEATURE (28)..(29): Xaa = any amino acid, non amino acid, or is absent
XXXTPAXFXXXXXAPWXXAXXAPXIXXXX

SEQ ID NO: 37027 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Ile, Phe, Trp, Tyr or Ala
  MISC_FEATURE (12)..(12): Xaa = Asp, Ala, Gln, Glu, Gly, His, Ile, Leu, Phe, Pro, Thr or Tyr
  MISC_FEATURE (13)..(13): Xaa = Gln, Leu, Trp or Tyr
  MISC_FEATURE (17)..(17): Xaa = any amino acid, non amino acid, or is absent
  MISC_FEATURE (19)..(19): Xaa = Glu, Gly, Trp or Phe
  MISC_FEATURE (20)..(20): Xaa = Gly, Ala or Asn
  MISC_FEATURE (23)..(23): Xaa = His, Trp or Lys
  MISC_FEATURE (28)..(29): Xaa = any amino acid, non amino acid, or is absent
XXXTPAXFXXXXXAPWXHXXQPXAQEPXX

SEQ ID NO: 37028 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXTPAXFXXPPXXXXPXXXGFXLKXXXX

SEQ ID NO: 37029 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXTPAXFXXPPXXXXPXXXTPAXXXXXXX

SEQ ID NO: 37030 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXTPAXFXXPPXXXXPXXXXAPWXX

SEQ ID NO: 37031 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXTPAXFXXPPXXXXPXPPXXXXPXX

SEQ ID NO: 37032 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXTPAXFXXPPXXXXPXXXXXXXXXX

SEQ ID NO: 37033 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXTPAXFXXPPXXXXPXFXPPAPXXX

SEQ ID NO: 37034 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXTPAXFXXPPXXXXPXDFTXFPPXX

SEQ ID NO: 37035 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXTPAXFXXPPXXXXPXXTPAXFXXX

SEQ ID NO: 37036 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXTPAXFXXPPXXXXPXXARXTPXSPPXX

SEQ ID NO: 37037 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXTPAXFXXPPXXXXPXXXTAYKPXXX

SEQ ID NO: 37038 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXTPAXFXXPPXXXXPXXAXXAPXIXXXX

SEQ ID NO: 37039 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (13)..(13): Xaa = Tyr or Pro
  MISC_FEATURE (14)..(14): Xaa = Trp, Tyr, Phe, Ala, Val, Cys, Thr, Leu, Ser, His, Gln, Glu, Gly or Ile
  MISC_FEATURE (15)..(15): Xaa = Trp, Ile, Phe, Pro, Asp, Gly, Cys or Ala
  MISC_FEATURE (16)..(16): Xaa = Gly or Asn
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXTPAXFXXPPXXXXPXHXXQPXAQEPXX

SEQ ID NO: 37040 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXTPAXFXXXXXXXXXXXXGFXLKXXXX

SEQ ID NO: 37041 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXTPAXFXXXXXXXXXXXXTPAXXXXXXX

SEQ ID NO: 37042 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXTPAXFXXXXXXXXXXXXXAPWXX

SEQ ID NO: 37043 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXTPAXFXXXXXXXXXXPPXXXXPXX

SEQ ID NO: 37044 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXTPAXFXXXXXXXXXXXXXXXXXXX

SEQ ID NO: 37045 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXTPAXFXXXXXXXXXXFXPPAPXXX

SEQ ID NO: 37046 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXTPAXFXXXXXXXXXXDFTXFPPXX

SEQ ID NO: 37047 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXTPAXFXXXXXXXXXXXTPAXFXXX

SEQ ID NO: 37048 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXTPAXFXXXXXXXXXXXARXTPXSPPXX

SEQ ID NO: 37049 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXTPAXFXXXXXXXXXXXXTAYKPXXX

SEQ ID NO: 37050 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXTPAXFXXXXXXXXXXXAXXAPXIXXXX

SEQ ID NO: 37051 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Gly, Tyr or Trp
  MISC_FEATURE (12)..(12): Xaa = Trp, Val, Ile, Phe, Arg, Met, Ser or Leu
  MISC_FEATURE (13)..(13): Xaa = Ile or Gly
  MISC_FEATURE (14)..(14): Xaa = Tyr, Pro, His, Leu or Phe
  MISC_FEATURE (15)..(15): Xaa = Ile, Asp, Tyr, Phe, Val, Thr, Gly, Ala or Gln
  MISC_FEATURE (16)..(16): Xaa = Phe, Arg, Cys, Leu, Ala, Gln, Asp or Val
  MISC_FEATURE (17)..(17): Xaa = Phe or Tyr
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXTPAXFXXXXXXXXXXHXXQPXAQEPXX

SEQ ID NO: 37052 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXTPAXFXXFXPPAPXXXXGFXLKXXXX

SEQ ID NO: 37053 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXTPAXFXXFXPPAPXXXXTPAXXXXXXX

SEQ ID NO: 37054 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXTPAXFXXFXPPAPXXXXXAPWXX

SEQ ID NO: 37055 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXTPAXFXXFXPPAPXXPPXXXXPXX

SEQ ID NO: 37056 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXTPAXFXXFXPPAPXXXXXXXXXXX

SEQ ID NO: 37057 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXTPAXFXXFXPPAPXXFXPPAPXXX

SEQ ID NO: 37058 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXTPAXFXXFXPPAPXXDFTXFPPXX

SEQ ID NO: 37059 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXTPAXFXXFXPPAPXXXTPAXFXXX

SEQ ID NO: 37060 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXTPAXFXXFXPPAPXXXARXTPXSPPXX

SEQ ID NO: 37061 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXTPAXFXXFXPPAPXXXXTAYKPXXX

SEQ ID NO: 37062 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXTPAXFXXFXPPAPXXXAXXAPXIXXXX

SEQ ID NO: 37063 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Pro or Ser
  MISC_FEATURE (17)..(17): Xaa = Pro, Tyr, Leu, Ala, Glu, Gly, Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXTPAXFXXFXPPAPXXHXXQPXAQEPXX

SEQ ID NO: 37064 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXTPAXFXXDFTXFPPXXXGFXLKXXXX

SEQ ID NO: 37065 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXTPAXFXXDFTXFPPXXXTPAXXXXXXX

SEQ ID NO: 37066 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXTPAXFXXDFTXFPPXXXXAPWXX

SEQ ID NO: 37067 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXTPAXFXXDFTXFPPXPPXXXXPXX

SEQ ID NO: 37068 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXTPAXFXXDFTXFPPXXXXXXXXXX

SEQ ID NO: 37069 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXTPAXFXXDFTXFPPXFXPPAPXXX

SEQ ID NO: 37070 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXTPAXFXXDFTXFPPXDFTXFPPXX

SEQ ID NO: 37071 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXTPAXFXXDFTXFPPXXTPAXFXXX

SEQ ID NO: 37072 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXTPAXFXXDFTXFPPXXARXTPXSPPXX

SEQ ID NO: 37073 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXTPAXFXXDFTXFPPXXXTAYKPXXX

SEQ ID NO: 37074 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXTPAXFXXDFTXFPPXXAXXAPXIXXXX

SEQ ID NO: 37075 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (14)..(14): Xaa = Val or Ile
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXTPAXFXXDFTXFPPXHXXQPXAQEPXX

SEQ ID NO: 37076 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXTPAXFXXXTPAXFXXXXGFXLKXXXX

SEQ ID NO: 37077 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXTPAXFXXXTPAXFXXXXTPAXXXXXXX

SEQ ID NO: 37078 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXTPAXFXXXTPAXFXXXXXAPWXX

SEQ ID NO: 37079 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXTPAXFXXXTPAXFXXPPXXXXPXX

SEQ ID NO: 37080 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXTPAXFXXXTPAXFXXXXXXXXXXX

SEQ ID NO: 37081 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXTPAXFXXXTPAXFXXFXPPAPXXX

SEQ ID NO: 37082 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXTPAXFXXXTPAXFXXDFTXFPPXX

SEQ ID NO: 37083 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXTPAXFXXXTPAXFXXXTPAXFXXX

SEQ ID NO: 37084 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXTPAXFXXXTPAXFXXXARXTPXSPPXX

SEQ ID NO: 37085 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXTPAXFXXXTPAXFXXXXTAYKPXXX

SEQ ID NO: 37086 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXTPAXFXXXTPAXFXXXAXXAPXIXXXX

SEQ ID NO: 37087 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Tyr, Thr or His
  MISC_FEATURE (15)..(15): Xaa = His or Ile
  MISC_FEATURE (17)..(17): Xaa = Tyr or Ala
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXTPAXFXXXTPAXFXXHXXQPXAQEPXX

SEQ ID NO: 37088 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXTPAXFXXXARXTPXSPPXXXGFXLKXXXX

SEQ ID NO: 37089 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXTPAXFXXXARXTPXSPPXXXTPAXXXXXXX

SEQ ID NO: 37090 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXTPAXFXXXARXTPXSPPXXXXAPWXX

SEQ ID NO: 37091 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXTPAXFXXXARXTPXSPPXPPXXXXPXX

SEQ ID NO: 37092 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXTPAXFXXXARXTPXSPPXXXXXXXXXX

SEQ ID NO: 37093 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXTPAXFXXXARXTPXSPPXFXPPAPXXX

SEQ ID NO: 37094 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXTPAXFXXXARXTPXSPPXDFTXFPPXX

SEQ ID NO: 37095 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXTPAXFXXXARXTPXSPPXXTPAXFXXX

SEQ ID NO: 37096 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXTPAXFXXXARXTPXSPPXXARXTPXSPPXX

SEQ ID NO: 37097 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXTPAXFXXXARXTPXSPPXXXTAYKPXXX

SEQ ID NO: 37098 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXTPAXFXXXARXTPXSPPXXAXXAPXIXXXX

SEQ ID NO: 37099 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Pro or Ala
  MISC_FEATURE (14)..(14): Xaa = Ala, Pro, Trp, Asn or Leu
  MISC_FEATURE (17)..(17): Xaa = Pro or Phe
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXTPAXFXXXARXTPXSPPXHXXQPXAQEPXX

SEQ ID NO: 37100 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXTPAXFXXXXTAYKPXXXXGFXLKXXXX

SEQ ID NO: 37101 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXTPAXFXXXXTAYKPXXXXTPAXXXXXXX

SEQ ID NO: 37102 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXTPAXFXXXXTAYKPXXXXXAPWXX

SEQ ID NO: 37103 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXTPAXFXXXXTAYKPXXPPXXXXPXX

SEQ ID NO: 37104 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXTPAXFXXXXTAYKPXXXXXXXXXXX

SEQ ID NO: 37105 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXTPAXFXXXXTAYKPXXFXPPAPXXX

SEQ ID NO: 37106 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXTPAXFXXXXTAYKPXXDFTXFPPXX

SEQ ID NO: 37107 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXTPAXFXXXXTAYKPXXXTPAXFXXX

SEQ ID NO: 37108 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXTPAXFXXXXTAYKPXXXARXTPXSPPXX

SEQ ID NO: 37109 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXTPAXFXXXXTAYKPXXXXTAYKPXXX

SEQ ID NO: 37110 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXTPAXFXXXXTAYKPXXXAXXAPXIXXXX

SEQ ID NO: 37111 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Trp or Leu
  MISC_FEATURE (12)..(12): Xaa = Ala, Asn, Ser, Trp or Glu
  MISC_FEATURE (18)..(18): Xaa = Ser or Phe
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXTPAXFXXXXTAYKPXXHXXQPXAQEPXX

SEQ ID NO: 37112 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXTPAXFXXXAXXAPXIXXXXXGFXLKXXXX

SEQ ID NO: 37113 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXTPAXFXXXAXXAPXIXXXXXTPAXXXXXXX

SEQ ID NO: 37114 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXTPAXFXXXAXXAPXIXXXXXXAPWXX

SEQ ID NO: 37115 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXTPAXFXXXAXXAPXIXXXPPXXXXPXX

SEQ ID NO: 37116 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXTPAXFXXXAXXAPXIXXXXXXXXXXXX

SEQ ID NO: 37117 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXTPAXFXXXAXXAPXIXXXFXPPAPXXX

SEQ ID NO: 37118 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXTPAXFXXXAXXAPXIXXXDFTXFPPXX

SEQ ID NO: 37119 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXTPAXFXXXAXXAPXIXXXXTPAXFXXX

SEQ ID NO: 37120 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXTPAXFXXXAXXAPXIXXXXARXTPXSPPXX

SEQ ID NO: 37121 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXTPAXFXXXAXXAPXIXXXXXTAYKPXXX

SEQ ID NO: 37122 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXTPAXFXXXAXXAPXIXXXXAXXAPXIXXXX

SEQ ID NO: 37123 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (11)..(11): Xaa = Asn, Trp or Ala
  MISC_FEATURE (13)..(13): Xaa = Phe, Asn, Tyr or Pro
  MISC_FEATURE (14)..(14): Xaa = Pro, His, Tyr, Trp or Ala
  MISC_FEATURE (17)..(17): Xaa = Tyr or Ala
  MISC_FEATURE (19)..(19): Xaa = Trp or Gln
  MISC_FEATURE (20)..(20): Xaa = Arg or Gln
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXTPAXFXXXAXXAPXIXXXHXXQPXAQEPXX

SEQ ID NO: 37124 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXTPAXFXXHXXQPXAQEPXXXGFXLKXXXX

SEQ ID NO: 37125 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXTPAXFXXHXXQPXAQEPXXXTPAXXXXXXX

SEQ ID NO: 37126 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXTPAXFXXHXXQPXAQEPXXXXAPWXX

SEQ ID NO: 37127 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXTPAXFXXHXXQPXAQEPXPPXXXXPXX

SEQ ID NO: 37128 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXTPAXFXXHXXQPXAQEPXXXXXXXXXX

SEQ ID NO: 37129 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXTPAXFXXHXXQPXAQEPXFXPPAPXXX

SEQ ID NO: 37130 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXTPAXFXXHXXQPXAQEPXDFTXFPPXX

SEQ ID NO: 37131 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXTPAXFXXHXXQPXAQEPXXTPAXFXXX

SEQ ID NO: 37132 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXTPAXFXXHXXQPXAQEPXXARXTPXSPPXX

SEQ ID NO: 37133 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXTPAXFXXHXXQPXAQEPXXXTAYKPXXX

SEQ ID NO: 37134 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXTPAXFXXHXXQPXAQEPXXAXXAPXIXXXX

SEQ ID NO: 37135 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(10): Xaa = any amino acid, non amino acid, or is absent
  MISC_FEATURE (12)..(12): Xaa = Glu, Gly, Trp or Phe
  MISC_FEATURE (13)..(13): Xaa = Gly, Ala or Asn
  MISC_FEATURE (16)..(16): Xaa = His, Trp or Lys
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXTPAXFXXHXXQPXAQEPXHXXQPXAQEPXX

SEQ ID NO: 37136 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXXARXTPXSPPXXXGFXLKXXXXXGFXLKXXXX

SEQ ID NO: 37137 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXXARXTPXSPPXXXGFXLKXXXXXTPAXXXXXXX

SEQ ID NO: 37138 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXXARXTPXSPPXXXGFXLKXXXXXXAPWXX

SEQ ID NO: 37139 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXXARXTPXSPPXXXGFXLKXXXPPXXXXPXX

SEQ ID NO: 37140 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXXARXTPXSPPXXXGFXLKXXXXXXXXXXXX

SEQ ID NO: 37141 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXXARXTPXSPPXXXGFXLKXXXFXPPAPXXX

SEQ ID NO: 37142 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXXARXTPXSPPXXXGFXLKXXXDFTXFPPXX

SEQ ID NO: 37143 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXXARXTPXSPPXXXGFXLKXXXXTPAXFXXX

SEQ ID NO: 37144 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXXARXTPXSPPXXXGFXLKXXXXARXTPXSPPXX

SEQ ID NO: 37145 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXXARXTPXSPPXXXGFXLKXXXXXTAYKPXXX

SEQ ID NO: 37146 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXXARXTPXSPPXXXGFXLKXXXXAXXAPXIXXXX

SEQ ID NO: 37147 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXXARXTPXSPPXXXGFXLKXXXHXXQPXAQEPXX

SEQ ID NO: 37148 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXARXTPXSPPXXXTPAXXXXXXXXGFXLKXXXX

SEQ ID NO: 37149 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXARXTPXSPPXXXTPAXXXXXXXXTPAXXXXXXX

SEQ ID NO: 37150 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXARXTPXSPPXXXTPAXXXXXXXXXAPWXX

SEQ ID NO: 37151 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXARXTPXSPPXXXTPAXXXXXXPPXXXXPXX

SEQ ID NO: 37152 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXARXTPXSPPXXXTPAXXXXXXXXXXXXXXX

SEQ ID NO: 37153 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXARXTPXSPPXXXTPAXXXXXXFXPPAPXXX

SEQ ID NO: 37154 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXARXTPXSPPXXXTPAXXXXXXDFTXFPPXX

SEQ ID NO: 37155 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXARXTPXSPPXXXTPAXXXXXXXTPAXFXXX

SEQ ID NO: 37156 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXARXTPXSPPXXXTPAXXXXXXXARXTPXSPPXX

SEQ ID NO: 37157 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXARXTPXSPPXXXTPAXXXXXXXXTAYKPXXX

SEQ ID NO: 37158 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXARXTPXSPPXXXTPAXXXXXXXAXXAPXIXXXX

SEQ ID NO: 37159 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXARXTPXSPPXXXTPAXXXXXXHXXQPXAQEPXX

SEQ ID NO: 37160 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXARXTPXSPPXXXXAPWXXXGFXLKXXXX

SEQ ID NO: 37161 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXARXTPXSPPXXXXAPWXXXTPAXXXXXXX

SEQ ID NO: 37162 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXARXTPXSPPXXXXAPWXXXXAPWXX

SEQ ID NO: 37163 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXARXTPXSPPXXXXAPWXPPXXXXPXX

SEQ ID NO: 37164 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXARXTPXSPPXXXXAPWXXXXXXXXXX

SEQ ID NO: 37165 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXARXTPXSPPXXXXAPWXFXPPAPXXX

SEQ ID NO: 37166 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXARXTPXSPPXXXXAPWXDFTXFPPXX

SEQ ID NO: 37167 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXARXTPXSPPXXXXAPWXXTPAXFXXX

SEQ ID NO: 37168 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXARXTPXSPPXXXXAPWXXARXTPXSPPXX

SEQ ID NO: 37169 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXARXTPXSPPXXXXAPWXXXTAYKPXXX

SEQ ID NO: 37170 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXARXTPXSPPXXXXAPWXXAXXAPXIXXXX

SEQ ID NO: 37171 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXARXTPXSPPXXXXAPWXHXXQPXAQEPXX

SEQ ID NO: 37172 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXARXTPXSPPXPPXXXXPXXXGFXLKXXXX

SEQ ID NO: 37173 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXARXTPXSPPXPPXXXXPXXXTPAXXXXXXX

SEQ ID NO: 37174 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXARXTPXSPPXPPXXXXPXXXXAPWXX

SEQ ID NO: 37175 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXARXTPXSPPXPPXXXXPXPPXXXXPXX

SEQ ID NO: 37176 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXARXTPXSPPXPPXXXXPXXXXXXXXXX

SEQ ID NO: 37177 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXARXTPXSPPXPPXXXXPXFXPPAPXXX

SEQ ID NO: 37178 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXARXTPXSPPXPPXXXXPXDFTXFPPXX

SEQ ID NO: 37179 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXARXTPXSPPXPPXXXXPXXTPAXFXXX

SEQ ID NO: 37180 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXARXTPXSPPXPPXXXXPXXARXTPXSPPXX

SEQ ID NO: 37181 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXARXTPXSPPXPPXXXXPXXXTAYKPXXX

SEQ ID NO: 37182 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXARXTPXSPPXPPXXXXPXXAXXAPXIXXXX

SEQ ID NO: 37183 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXARXTPXSPPXPPXXXXPXHXXQPXAQEPXX

SEQ ID NO: 37184 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXARXTPXSPPXXXXXXXXXXXGFXLKXXXX

SEQ ID NO: 37185 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXARXTPXSPPXXXXXXXXXXXTPAXXXXXXX

SEQ ID NO: 37186 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXARXTPXSPPXXXXXXXXXXXXAPWXX

SEQ ID NO: 37187 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXARXTPXSPPXXXXXXXXXPPXXXXPXX

SEQ ID NO: 37188 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXARXTPXSPPXXXXXXXXXXXXXXXXXX

SEQ ID NO: 37189 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXARXTPXSPPXXXXXXXXXFXPPAPXXX

SEQ ID NO: 37190 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXARXTPXSPPXXXXXXXXXDFTXFPPXX

SEQ ID NO: 37191 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXARXTPXSPPXXXXXXXXXXTPAXFXXX

SEQ ID NO: 37192 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXARXTPXSPPXXXXXXXXXXARXTPXSPPXX

SEQ ID NO: 37193 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXARXTPXSPPXXXXXXXXXXXTAYKPXXX

SEQ ID NO: 37194 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXARXTPXSPPXXXXXXXXXXAXXAPXIXXXX

SEQ ID NO: 37195 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXARXTPXSPPXXXXXXXXXHXXQPXAQEPXX

SEQ ID NO: 37196 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXARXTPXSPPXFXPPAPXXXXGFXLKXXXX

SEQ ID NO: 37197 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXARXTPXSPPXFXPPAPXXXXTPAXXXXXXX

SEQ ID NO: 37198 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXARXTPXSPPXFXPPAPXXXXXAPWXX

SEQ ID NO: 37199 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXARXTPXSPPXFXPPAPXXPPXXXXPXX

SEQ ID NO: 37200 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXARXTPXSPPXFXPPAPXXXXXXXXXXX

SEQ ID NO: 37201 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXARXTPXSPPXFXPPAPXXFXPPAPXXX

SEQ ID NO: 37202 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXARXTPXSPPXFXPPAPXXDFTXFPPXX

SEQ ID NO: 37203 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXARXTPXSPPXFXPPAPXXXTPAXFXXX

SEQ ID NO: 37204 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXARXTPXSPPXFXPPAPXXXARXTPXSPPXX

SEQ ID NO: 37205 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXARXTPXSPPXFXPPAPXXXXTAYKPXXX

SEQ ID NO: 37206 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXARXTPXSPPXFXPPAPXXXAXXAPXIXXXX

SEQ ID NO: 37207 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXARXTPXSPPXFXPPAPXXHXXQPXAQEPXX

SEQ ID NO: 37208 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXARXTPXSPPXDFTXFPPXXXGFXLKXXXX

SEQ ID NO: 37209 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXARXTPXSPPXDFTXFPPXXXTPAXXXXXXX

SEQ ID NO: 37210 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXARXTPXSPPXDFTXFPPXXXXAPWXX

SEQ ID NO: 37211 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXARXTPXSPPXDFTXFPPXPPXXXXPXX

SEQ ID NO: 37212 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXARXTPXSPPXDFTXFPPXXXXXXXXXX

SEQ ID NO: 37213 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXARXTPXSPPXDFTXFPPXFXPPAPXXX

SEQ ID NO: 37214 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXARXTPXSPPXDFTXFPPXDFTXFPPXX

SEQ ID NO: 37215 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXARXTPXSPPXDFTXFPPXXTPAXFXXX

SEQ ID NO: 37216 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXARXTPXSPPXDFTXFPPXXARXTPXSPPXX

SEQ ID NO: 37217 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXARXTPXSPPXDFTXFPPXXXTAYKPXXX

SEQ ID NO: 37218 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXARXTPXSPPXDFTXFPPXXAXXAPXIXXXX

SEQ ID NO: 37219 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXARXTPXSPPXDFTXFPPXHXXQPXAQEPXX

SEQ ID NO: 37220 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXARXTPXSPPXXTPAXFXXXXGFXLKXXXX

SEQ ID NO: 37221 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXARXTPXSPPXXTPAXFXXXXTPAXXXXXXX

SEQ ID NO: 37222 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXARXTPXSPPXXTPAXFXXXXXAPWXX

SEQ ID NO: 37223 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXARXTPXSPPXXTPAXFXXPPXXXXPXX

SEQ ID NO: 37224 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXARXTPXSPPXXTPAXFXXXXXXXXXXX

SEQ ID NO: 37225 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXARXTPXSPPXXTPAXFXXFXPPAPXXX

SEQ ID NO: 37226 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXARXTPXSPPXXTPAXFXXDFTXFPPXX

SEQ ID NO: 37227 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXARXTPXSPPXXTPAXFXXXTPAXFXXX

SEQ ID NO: 37228 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXARXTPXSPPXXTPAXFXXXARXTPXSPPXX

SEQ ID NO: 37229 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXARXTPXSPPXXTPAXFXXXXTAYKPXXX

SEQ ID NO: 37230 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXARXTPXSPPXXTPAXFXXXAXXAPXIXXXX

SEQ ID NO: 37231 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXARXTPXSPPXXTPAXFXXHXXQPXAQEPXX

SEQ ID NO: 37232 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXARXTPXSPPXXARXTPXSPPXXXGFXLKXXXX

SEQ ID NO: 37233 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXARXTPXSPPXXARXTPXSPPXXXTPAXXXXXXX

SEQ ID NO: 37234 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXARXTPXSPPXXARXTPXSPPXXXXAPWXX

SEQ ID NO: 37235 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXARXTPXSPPXXARXTPXSPPXPPXXXXPXX

SEQ ID NO: 37236 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXARXTPXSPPXXARXTPXSPPXXXXXXXXXX

SEQ ID NO: 37237 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXARXTPXSPPXXARXTPXSPPXFXPPAPXXX

SEQ ID NO: 37238 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXARXTPXSPPXXARXTPXSPPXDFTXFPPXX

SEQ ID NO: 37239 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXARXTPXSPPXXARXTPXSPPXXTPAXFXXX

SEQ ID NO: 37240 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXARXTPXSPPXXARXTPXSPPXXARXTPXSPPXX

SEQ ID NO: 37241 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXARXTPXSPPXXARXTPXSPPXXXTAYKPXXX

SEQ ID NO: 37242 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXARXTPXSPPXXARXTPXSPPXXAXXAPXIXXXX

SEQ ID NO: 37243 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXARXTPXSPPXXARXTPXSPPXHXXQPXAQEPXX

SEQ ID NO: 37244 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXARXTPXSPPXXXTAYKPXXXXGFXLKXXXX

SEQ ID NO: 37245 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXARXTPXSPPXXXTAYKPXXXXTPAXXXXXXX

SEQ ID NO: 37246 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXARXTPXSPPXXXTAYKPXXXXXAPWXX

SEQ ID NO: 37247 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXARXTPXSPPXXXTAYKPXXPPXXXXPXX

SEQ ID NO: 37248 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXARXTPXSPPXXXTAYKPXXXXXXXXXXX

SEQ ID NO: 37249 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXARXTPXSPPXXXTAYKPXXFXPPAPXXX

SEQ ID NO: 37250 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXARXTPXSPPXXXTAYKPXXDFTXFPPXX

SEQ ID NO: 37251 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXARXTPXSPPXXXTAYKPXXXTPAXFXXX

SEQ ID NO: 37252 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXARXTPXSPPXXXTAYKPXXXARXTPXSPPXX

SEQ ID NO: 37253 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXARXTPXSPPXXXTAYKPXXXXTAYKPXXX

SEQ ID NO: 37254 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXARXTPXSPPXXXTAYKPXXXAXXAPXIXXXX

SEQ ID NO: 37255 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXARXTPXSPPXXXTAYKPXXHXXQPXAQEPXX

SEQ ID NO: 37256 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXARXTPXSPPXXAXXAPXIXXXXXGFXLKXXXX

SEQ ID NO: 37257 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXARXTPXSPPXXAXXAPXIXXXXXTPAXXXXXXX

SEQ ID NO: 37258 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXARXTPXSPPXXAXXAPXIXXXXXXAPWXX

SEQ ID NO: 37259 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXARXTPXSPPXXAXXAPXIXXXPPXXXXPXX

SEQ ID NO: 37260 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXARXTPXSPPXXAXXAPXIXXXXXXXXXXXX

SEQ ID NO: 37261 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXARXTPXSPPXXAXXAPXIXXXFXPPAPXXX

SEQ ID NO: 37262 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXARXTPXSPPXXAXXAPXIXXXDFTXFPPXX

SEQ ID NO: 37263 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXARXTPXSPPXXAXXAPXIXXXXTPAXFXXX

SEQ ID NO: 37264 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXARXTPXSPPXXAXXAPXIXXXXARXTPXSPPXX

SEQ ID NO: 37265 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXARXTPXSPPXXAXXAPXIXXXXXTAYKPXXX

SEQ ID NO: 37266 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXARXTPXSPPXXAXXAPXIXXXXAXXAPXIXXXX

SEQ ID NO: 37267 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXARXTPXSPPXXAXXAPXIXXXHXXQPXAQEPXX

SEQ ID NO: 37268 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXARXTPXSPPXHXXQPXAQEPXXXGFXLKXXXX

SEQ ID NO: 37269 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXARXTPXSPPXHXXQPXAQEPXXXTPAXXXXXXX

SEQ ID NO: 37270 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXARXTPXSPPXHXXQPXAQEPXXXXAPWXX

SEQ ID NO: 37271 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXARXTPXSPPXHXXQPXAQEPXPPXXXXPXX

SEQ ID NO: 37272 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXARXTPXSPPXHXXQPXAQEPXXXXXXXXXX

SEQ ID NO: 37273 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXARXTPXSPPXHXXQPXAQEPXFXPPAPXXX

SEQ ID NO: 37274 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXARXTPXSPPXHXXQPXAQEPXDFTXFPPXX

SEQ ID NO: 37275 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXARXTPXSPPXHXXQPXAQEPXXTPAXFXXX

SEQ ID NO: 37276 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXARXTPXSPPXHXXQPXAQEPXXARXTPXSPPXX

SEQ ID NO: 37277 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXARXTPXSPPXHXXQPXAQEPXXXTAYKPXXX

SEQ ID NO: 37278 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXARXTPXSPPXHXXQPXAQEPXXAXXAPXIXXXX

SEQ ID NO: 37279 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXARXTPXSPPXHXXQPXAQEPXHXXQPXAQEPXX

SEQ ID NO: 37280 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXXTAYKPXXXXGFXLKXXXXXGFXLKXXXX

SEQ ID NO: 37281 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXXTAYKPXXXXGFXLKXXXXXTPAXXXXXXX

SEQ ID NO: 37282 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXXTAYKPXXXXGFXLKXXXXXXAPWXX

SEQ ID NO: 37283 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXXTAYKPXXXXGFXLKXXXPPXXXXPXX

SEQ ID NO: 37284 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXXTAYKPXXXXGFXLKXXXXXXXXXXXX

SEQ ID NO: 37285 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXXTAYKPXXXXGFXLKXXXFXPPAPXXX

SEQ ID NO: 37286 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXXTAYKPXXXXGFXLKXXXDFTXFPPXX

SEQ ID NO: 37287 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXXTAYKPXXXXGFXLKXXXXTPAXFXXX

SEQ ID NO: 37288 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXXTAYKPXXXXGFXLKXXXXARXTPXSPPXX

SEQ ID NO: 37289 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXXTAYKPXXXXGFXLKXXXXXTAYKPXXX

SEQ ID NO: 37290 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXXTAYKPXXXXGFXLKXXXXAXXAPXIXXXX

SEQ ID NO: 37291 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (16)..(16): Xaa = any amino acid, non amino acid, or is absent
  MISC_FEATURE (19)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXXTAYKPXXXXGFXLKXXXHXXQPXAQEPXX

SEQ ID NO: 37292 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXXTAYKPXXXXTPAXXXXXXXXGFXLKXXXX

SEQ ID NO: 37293 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXXTAYKPXXXXTPAXXXXXXXXTPAXXXXXXX

SEQ ID NO: 37294 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXXTAYKPXXXXTPAXXXXXXXXXAPWXX

SEQ ID NO: 37295 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXXTAYKPXXXXTPAXXXXXXPPXXXXPXX

SEQ ID NO: 37296 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXXTAYKPXXXXTPAXXXXXXXXXXXXXXX

SEQ ID NO: 37297 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXXTAYKPXXXXTPAXXXXXXFXPPAPXXX

SEQ ID NO: 37298 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXXTAYKPXXXXTPAXXXXXXDFTXFPPXX

SEQ ID NO: 37299 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXXTAYKPXXXXTPAXXXXXXXTPAXFXXX

SEQ ID NO: 37300 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXXTAYKPXXXXTPAXXXXXXXARXTPXSPPXX

SEQ ID NO: 37301 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXXTAYKPXXXXTPAXXXXXXXXTAYKPXXX

SEQ ID NO: 37302 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXXTAYKPXXXXTPAXXXXXXXAXXAPXIXXXX

SEQ ID NO: 37303 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(13): Xaa = any amino acid, non amino acid, or is absent
  MISC_FEATURE (17)..(17): Xaa = Asn or Asp
  MISC_FEATURE (18)..(18): Xaa = Asn or Glu
  MISC_FEATURE (19)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXXTAYKPXXXXTPAXXXXXXHXXQPXAQEPXX

SEQ ID NO: 37304 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(20): Xaa = any amino acid, non amino acid, or is absent
  MISC_FEATURE (23)..(23): Xaa = any amino acid, non amino acid, or is absent
  MISC_FEATURE (26)..(29): Xaa = any amino acid, non amino acid, or is absent
XXXXTAYKPXXXXXAPWXXXGFXLKXXXX

SEQ ID NO: 37305 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(20): Xaa = any amino acid, non amino acid, or is absent
  MISC_FEATURE (24)..(24): Xaa = Asn or Asp
  MISC_FEATURE (25)..(25): Xaa = Asn or Glu
  MISC_FEATURE (26)..(30): Xaa = any amino acid, non amino acid, or is absent
XXXXTAYKPXXXXXAPWXXXTPAXXXXXXX

SEQ ID NO: 37306 - protein, 26 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (19)..(19): Xaa = Ile, Phe, Trp, Tyr or Ala
  MISC_FEATURE (20)..(20): Xaa = Asp, Ala, Gln, Glu, Gly, His, Ile, Leu, Phe, Pro, Thr or Tyr
  MISC_FEATURE (21)..(21): Xaa = Gln, Leu, Trp or Tyr
  MISC_FEATURE (25)..(26): Xaa = any amino acid, non amino acid, or is absent
XXXXTAYKPXXXXXAPWXXXXAPWXX

SEQ ID NO: 37307 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (21)..(21): Xaa = Tyr or Pro
  MISC_FEATURE (22)..(22): Xaa = Trp, Tyr, Phe, Ala, Val, Cys, Thr, Leu, Ser, His, Gln, Glu, Gly or Ile
  MISC_FEATURE (23)..(23): Xaa = Trp, Ile, Phe, Pro, Asp, Gly, Cys or Ala
  MISC_FEATURE (24)..(24): Xaa = Gly or Asn
  MISC_FEATURE (26)..(27): Xaa = any amino acid, non amino acid, or is absent
XXXXTAYKPXXXXXAPWXPPXXXXPXX

SEQ ID NO: 37308 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (19)..(19): Xaa = Gly, Tyr or Trp
  MISC_FEATURE (20)..(20): Xaa = Trp, Val, Ile, Phe, Arg, Met, Ser or Leu
  MISC_FEATURE (21)..(21): Xaa = Ile or Gly
  MISC_FEATURE (22)..(22): Xaa = Tyr, Pro, His, Leu or Phe
  MISC_FEATURE (23)..(23): Xaa = Ile, Asp, Tyr, Phe, Val, Thr, Gly, Ala or Gln
  MISC_FEATURE (24)..(24): Xaa = Phe, Arg, Cys, Leu, Ala, Gln, Asp or Val
  MISC_FEATURE (25)..(25): Xaa = Phe or Tyr
  MISC_FEATURE (26)..(27): Xaa = any amino acid, non amino acid, or is absent
XXXXTAYKPXXXXXAPWXXXXXXXXXX

SEQ ID NO: 37309 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (20)..(20): Xaa = Pro or Ser
  MISC_FEATURE (25)..(25): Xaa = Pro, Tyr, Leu, Ala, Glu, Gly, Val or Ile
  MISC_FEATURE (26)..(27): Xaa = any amino acid, non amino acid, or is absent
XXXXTAYKPXXXXXAPWXFXPPAPXXX

SEQ ID NO: 37310 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (22)..(22): Xaa = Val or Ile
  MISC_FEATURE (26)..(27): Xaa = any amino acid, non amino acid, or is absent
XXXXTAYKPXXXXXAPWXDFTXFPPXX

SEQ ID NO: 37311 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (19)..(19): Xaa = Tyr, Thr or His
  MISC_FEATURE (23)..(23): Xaa = His or Ile
  MISC_FEATURE (25)..(25): Xaa = Tyr or Ala
  MISC_FEATURE (26)..(27): Xaa = any amino acid, non amino acid, or is absent
XXXXTAYKPXXXXXAPWXXTPAXFXXX

SEQ ID NO: 37312 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (19)..(19): Xaa = Pro or Ala
  MISC_FEATURE (22)..(22): Xaa = Ala, Pro, Trp, Asn or Leu
  MISC_FEATURE (25)..(25): Xaa = Pro or Phe
  MISC_FEATURE (29)..(30): Xaa = any amino acid, non amino acid, or is absent
XXXXTAYKPXXXXXAPWXXARXTPXSPPXX

SEQ ID NO: 37313 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (19)..(19): Xaa = Trp or Leu
  MISC_FEATURE (20)..(20): Xaa = Ala, Asn, Ser, Trp or Glu
  MISC_FEATURE (26)..(26): Xaa = Ser or Phe
  MISC_FEATURE (27)..(28): Xaa = any amino acid, non amino acid, or is absent
XXXXTAYKPXXXXXAPWXXXTAYKPXXX

SEQ ID NO: 37314 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (19)..(19): Xaa = Asn, Trp or Ala
  MISC_FEATURE (21)..(21): Xaa = Phe, Asn, Tyr or Pro
  MISC_FEATURE (22)..(22): Xaa = Pro, His, Tyr, Trp or Ala
  MISC_FEATURE (25)..(25): Xaa = Tyr or Ala
  MISC_FEATURE (27)..(27): Xaa = Trp or Gln
  MISC_FEATURE (28)..(28): Xaa = Arg or Gln
  MISC_FEATURE (29)..(30): Xaa = any amino acid, non amino acid, or is absent
XXXXTAYKPXXXXXAPWXXAXXAPXIXXXX

SEQ ID NO: 37315 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Ile, Phe, Trp, Tyr or Ala
  MISC_FEATURE (13)..(13): Xaa = Asp, Ala, Gln, Glu, Gly, His, Ile, Leu, Phe, Pro, Thr or Tyr
  MISC_FEATURE (14)..(14): Xaa = Gln, Leu, Trp or Tyr
  MISC_FEATURE (18)..(18): Xaa = any amino acid, non amino acid, or is absent
  MISC_FEATURE (20)..(20): Xaa = Glu, Gly, Trp or Phe
  MISC_FEATURE (21)..(21): Xaa = Gly, Ala or Asn
  MISC_FEATURE (24)..(24): Xaa = His, Trp or Lys
  MISC_FEATURE (29)..(30): Xaa = any amino acid, non amino acid, or is absent
XXXXTAYKPXXXXXAPWXHXXQPXAQEPXX

SEQ ID NO: 37316 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXTAYKPXXPPXXXXPXXXGFXLKXXXX

SEQ ID NO: 37317 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXTAYKPXXPPXXXXPXXXTPAXXXXXXX

SEQ ID NO: 37318 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXTAYKPXXPPXXXXPXXXXAPWXX

SEQ ID NO: 37319 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXTAYKPXXPPXXXXPXPPXXXXPXX

SEQ ID NO: 37320 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXTAYKPXXPPXXXXPXXXXXXXXXX

SEQ ID NO: 37321 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXTAYKPXXPPXXXXPXFXPPAPXXX

SEQ ID NO: 37322 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXTAYKPXXPPXXXXPXDFTXFPPXX

SEQ ID NO: 37323 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXTAYKPXXPPXXXXPXXTPAXFXXX

SEQ ID NO: 37324 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXTAYKPXXPPXXXXPXXARXTPXSPPXX

SEQ ID NO: 37325 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXTAYKPXXPPXXXXPXXXTAYKPXXX

SEQ ID NO: 37326 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXTAYKPXXPPXXXXPXXAXXAPXIXXXX

SEQ ID NO: 37327 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (14)..(14): Xaa = Tyr or Pro
  MISC_FEATURE (15)..(15): Xaa = Trp, Tyr, Phe, Ala, Val, Cys, Thr, Leu, Ser, His, Gln, Glu, Gly or Ile
  MISC_FEATURE (16)..(16): Xaa = Trp, Ile, Phe, Pro, Asp, Gly, Cys or Ala
  MISC_FEATURE (17)..(17): Xaa = Gly or Asn
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXTAYKPXXPPXXXXPXHXXQPXAQEPXX

SEQ ID NO: 37328 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXTAYKPXXXXXXXXXXXXGFXLKXXXX

SEQ ID NO: 37329 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXTAYKPXXXXXXXXXXXXTPAXXXXXXX

SEQ ID NO: 37330 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXTAYKPXXXXXXXXXXXXXAPWXX

SEQ ID NO: 37331 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXTAYKPXXXXXXXXXXPPXXXXPXX

SEQ ID NO: 37332 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXTAYKPXXXXXXXXXXXXXXXXXXX

SEQ ID NO: 37333 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXTAYKPXXXXXXXXXXFXPPAPXXX

SEQ ID NO: 37334 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXTAYKPXXXXXXXXXXDFTXFPPXX

SEQ ID NO: 37335 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXTAYKPXXXXXXXXXXXTPAXFXXX

SEQ ID NO: 37336 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXTAYKPXXXXXXXXXXXARXTPXSPPXX

SEQ ID NO: 37337 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXTAYKPXXXXXXXXXXXXTAYKPXXX

SEQ ID NO: 37338 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXTAYKPXXXXXXXXXXXAXXAPXIXXXX

SEQ ID NO: 37339 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Gly, Tyr or Trp
  MISC_FEATURE (13)..(13): Xaa = Trp, Val, Ile, Phe, Arg, Met, Ser or Leu
  MISC_FEATURE (14)..(14): Xaa = Ile or Gly
  MISC_FEATURE (15)..(15): Xaa = Tyr, Pro, His, Leu or Phe
  MISC_FEATURE (16)..(16): Xaa = Ile, Asp, Tyr, Phe, Val, Thr, Gly, Ala or Gln
  MISC_FEATURE (17)..(17): Xaa = Phe, Arg, Cys, Leu, Ala, Gln, Asp or Val
  MISC_FEATURE (18)..(18): Xaa = Phe or Tyr
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXTAYKPXXXXXXXXXXHXXQPXAQEPXX

SEQ ID NO: 37340 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXTAYKPXXFXPPAPXXXXGFXLKXXXX

SEQ ID NO: 37341 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXTAYKPXXFXPPAPXXXXTPAXXXXXXX

SEQ ID NO: 37342 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXTAYKPXXFXPPAPXXXXXAPWXX

SEQ ID NO: 37343 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXTAYKPXXFXPPAPXXPPXXXXPXX

SEQ ID NO: 37344 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXTAYKPXXFXPPAPXXXXXXXXXXX

SEQ ID NO: 37345 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXTAYKPXXFXPPAPXXFXPPAPXXX

SEQ ID NO: 37346 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXTAYKPXXFXPPAPXXDFTXFPPXX

SEQ ID NO: 37347 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXTAYKPXXFXPPAPXXXTPAXFXXX

SEQ ID NO: 37348 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXTAYKPXXFXPPAPXXXARXTPXSPPXX

SEQ ID NO: 37349 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXTAYKPXXFXPPAPXXXXTAYKPXXX

SEQ ID NO: 37350 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXTAYKPXXFXPPAPXXXAXXAPXIXXXX

SEQ ID NO: 37351 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Pro or Ser
  MISC_FEATURE (18)..(18): Xaa = Pro, Tyr, Leu, Ala, Glu, Gly, Val or Ile
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXTAYKPXXFXPPAPXXHXXQPXAQEPXX

SEQ ID NO: 37352 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXTAYKPXXDFTXFPPXXXGFXLKXXXX

SEQ ID NO: 37353 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXTAYKPXXDFTXFPPXXXTPAXXXXXXX

SEQ ID NO: 37354 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXTAYKPXXDFTXFPPXXXXAPWXX

SEQ ID NO: 37355 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXTAYKPXXDFTXFPPXPPXXXXPXX

SEQ ID NO: 37356 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXTAYKPXXDFTXFPPXXXXXXXXXX

SEQ ID NO: 37357 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXTAYKPXXDFTXFPPXFXPPAPXXX

SEQ ID NO: 37358 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXTAYKPXXDFTXFPPXDFTXFPPXX

SEQ ID NO: 37359 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXTAYKPXXDFTXFPPXXTPAXFXXX

SEQ ID NO: 37360 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXTAYKPXXDFTXFPPXXARXTPXSPPXX

SEQ ID NO: 37361 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXTAYKPXXDFTXFPPXXXTAYKPXXX

SEQ ID NO: 37362 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXTAYKPXXDFTXFPPXXAXXAPXIXXXX

SEQ ID NO: 37363 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (15)..(15): Xaa = Val or Ile
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXTAYKPXXDFTXFPPXHXXQPXAQEPXX

SEQ ID NO: 37364 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(21): Xaa = any amino acid, non amino acid, or is absent
  MISC_FEATURE (24)..(24): Xaa = any amino acid, non amino acid, or is absent
  MISC_FEATURE (27)..(30): Xaa = any amino acid, non amino acid, or is absent
XXXXTAYKPXXXTPAXFXXXXGFXLKXXXX

SEQ ID NO: 37365 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(21): Xaa = any amino acid, non amino acid, or is absent
  MISC_FEATURE (25)..(25): Xaa = Asn or Asp
  MISC_FEATURE (26)..(26): Xaa = Asn or Glu
  MISC_FEATURE (27)..(31): Xaa = any amino acid, non amino acid, or is absent
XXXXTAYKPXXXTPAXFXXXXTPAXXXXXXX

SEQ ID NO: 37366 - protein, 27 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (20)..(20): Xaa = Ile, Phe, Trp, Tyr or Ala
  MISC_FEATURE (21)..(21): Xaa = Asp, Ala, Gln, Glu, Gly, His, Ile, Leu, Phe, Pro, Thr or Tyr
  MISC_FEATURE (22)..(22): Xaa = Gln, Leu, Trp or Tyr
  MISC_FEATURE (26)..(27): Xaa = any amino acid, non amino acid, or is absent
XXXXTAYKPXXXTPAXFXXXXXAPWXX

SEQ ID NO: 37367 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (22)..(22): Xaa = Tyr or Pro
  MISC_FEATURE (23)..(23): Xaa = Trp, Tyr, Phe, Ala, Val, Cys, Thr, Leu, Ser, His, Gln, Glu, Gly or Ile
  MISC_FEATURE (24)..(24): Xaa = Trp, Ile, Phe, Pro, Asp, Gly, Cys or Ala
  MISC_FEATURE (25)..(25): Xaa = Gly or Asn
  MISC_FEATURE (27)..(28): Xaa = any amino acid, non amino acid, or is absent
XXXXTAYKPXXXTPAXFXXPPXXXXPXX

SEQ ID NO: 37368 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (20)..(20): Xaa = Gly, Tyr or Trp
  MISC_FEATURE (21)..(21): Xaa = Trp, Val, Ile, Phe, Arg, Met, Ser or Leu
  MISC_FEATURE (22)..(22): Xaa = Ile or Gly
  MISC_FEATURE (23)..(23): Xaa = Tyr, Pro, His, Leu or Phe
  MISC_FEATURE (24)..(24): Xaa = Ile, Asp, Tyr, Phe, Val, Thr, Gly, Ala or Gln
  MISC_FEATURE (25)..(25): Xaa = Phe, Arg, Cys, Leu, Ala, Gln, Asp or Val
  MISC_FEATURE (26)..(26): Xaa = Phe or Tyr
  MISC_FEATURE (27)..(28): Xaa = any amino acid, non amino acid, or is absent
XXXXTAYKPXXXTPAXFXXXXXXXXXXX

SEQ ID NO: 37369 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (21)..(21): Xaa = Pro or Ser
  MISC_FEATURE (26)..(26): Xaa = Pro, Tyr, Leu, Ala, Glu, Gly, Val or Ile
  MISC_FEATURE (27)..(28): Xaa = any amino acid, non amino acid, or is absent
XXXXTAYKPXXXTPAXFXXFXPPAPXXX

SEQ ID NO: 37370 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (23)..(23): Xaa = Val or Ile
  MISC_FEATURE (27)..(28): Xaa = any amino acid, non amino acid, or is absent
XXXXTAYKPXXXTPAXFXXDFTXFPPXX

SEQ ID NO: 37371 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (20)..(20): Xaa = Tyr, Thr or His
  MISC_FEATURE (24)..(24): Xaa = His or Ile
  MISC_FEATURE (26)..(26): Xaa = Tyr or Ala
  MISC_FEATURE (27)..(28): Xaa = any amino acid, non amino acid, or is absent
XXXXTAYKPXXXTPAXFXXXTPAXFXXX

SEQ ID NO: 37372 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (20)..(20): Xaa = Pro or Ala
  MISC_FEATURE (23)..(23): Xaa = Ala, Pro, Trp, Asn or Leu
  MISC_FEATURE (26)..(26): Xaa = Pro or Phe
  MISC_FEATURE (30)..(31): Xaa = any amino acid, non amino acid, or is absent
XXXXTAYKPXXXTPAXFXXXARXTPXSPPXX

SEQ ID NO: 37373 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (20)..(20): Xaa = Trp or Leu
  MISC_FEATURE (21)..(21): Xaa = Ala, Asn, Ser, Trp or Glu
  MISC_FEATURE (27)..(27): Xaa = Ser or Phe
  MISC_FEATURE (28)..(29): Xaa = any amino acid, non amino acid, or is absent
XXXXTAYKPXXXTPAXFXXXXTAYKPXXX

SEQ ID NO: 37374 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (20)..(20): Xaa = Asn, Trp or Ala
  MISC_FEATURE (22)..(22): Xaa = Phe, Asn, Tyr or Pro
  MISC_FEATURE (23)..(23): Xaa = Pro, His, Tyr, Trp or Ala
  MISC_FEATURE (26)..(26): Xaa = Tyr or Ala
  MISC_FEATURE (28)..(28): Xaa = Trp or Gln
  MISC_FEATURE (29)..(29): Xaa = Arg or Gln
  MISC_FEATURE (30)..(31): Xaa = any amino acid, non amino acid, or is absent
XXXXTAYKPXXXTPAXFXXXAXXAPXIXXXX

SEQ ID NO: 37375 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Tyr, Thr or His
  MISC_FEATURE (16)..(16): Xaa = His or Ile
  MISC_FEATURE (18)..(18): Xaa = Tyr or Ala
  MISC_FEATURE (19)..(19): Xaa = any amino acid, non amino acid, or is absent
  MISC_FEATURE (21)..(21): Xaa = Glu, Gly, Trp or Phe
  MISC_FEATURE (22)..(22): Xaa = Gly, Ala or Asn
  MISC_FEATURE (25)..(25): Xaa = His, Trp or Lys
  MISC_FEATURE (30)..(31): Xaa = any amino acid, non amino acid, or is absent
XXXXTAYKPXXXTPAXFXXHXXQPXAQEPXX

SEQ ID NO: 37376 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXXTAYKPXXXARXTPXSPPXXXGFXLKXXXX

SEQ ID NO: 37377 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXXTAYKPXXXARXTPXSPPXXXTPAXXXXXXX

SEQ ID NO: 37378 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXXTAYKPXXXARXTPXSPPXXXXAPWXX

SEQ ID NO: 37379 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXXTAYKPXXXARXTPXSPPXPPXXXXPXX

SEQ ID NO: 37380 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXXTAYKPXXXARXTPXSPPXXXXXXXXXX

SEQ ID NO: 37381 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXXTAYKPXXXARXTPXSPPXFXPPAPXXX

SEQ ID NO: 37382 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXXTAYKPXXXARXTPXSPPXDFTXFPPXX

SEQ ID NO: 37383 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXXTAYKPXXXARXTPXSPPXXTPAXFXXX

SEQ ID NO: 37384 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXXTAYKPXXXARXTPXSPPXXARXTPXSPPXX

SEQ ID NO: 37385 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXXTAYKPXXXARXTPXSPPXXXTAYKPXXX

SEQ ID NO: 37386 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXXTAYKPXXXARXTPXSPPXXAXXAPXIXXXX

SEQ ID NO: 37387 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Pro or Ala
  MISC_FEATURE (15)..(15): Xaa = Ala, Pro, Trp, Asn or Leu
  MISC_FEATURE (18)..(18): Xaa = Pro or Phe
  MISC_FEATURE (22)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXXTAYKPXXXARXTPXSPPXHXXQPXAQEPXX

SEQ ID NO: 37388 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXXTAYKPXXXXTAYKPXXXXGFXLKXXXX

SEQ ID NO: 37389 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXXTAYKPXXXXTAYKPXXXXTPAXXXXXXX

SEQ ID NO: 37390 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXXTAYKPXXXXTAYKPXXXXXAPWXX

SEQ ID NO: 37391 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXXTAYKPXXXXTAYKPXXPPXXXXPXX

SEQ ID NO: 37392 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXXTAYKPXXXXTAYKPXXXXXXXXXXX

SEQ ID NO: 37393 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXXTAYKPXXXXTAYKPXXFXPPAPXXX

SEQ ID NO: 37394 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXXTAYKPXXXXTAYKPXXDFTXFPPXX

SEQ ID NO: 37395 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXXTAYKPXXXXTAYKPXXXTPAXFXXX

SEQ ID NO: 37396 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXXTAYKPXXXXTAYKPXXXARXTPXSPPXX

SEQ ID NO: 37397 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXXTAYKPXXXXTAYKPXXXXTAYKPXXX

SEQ ID NO: 37398 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXXTAYKPXXXXTAYKPXXXAXXAPXIXXXX

SEQ ID NO: 37399 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Trp or Leu
  MISC_FEATURE (13)..(13): Xaa = Ala, Asn, Ser, Trp or Glu
  MISC_FEATURE (19)..(19): Xaa = Ser or Phe
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXXTAYKPXXXXTAYKPXXHXXQPXAQEPXX

SEQ ID NO: 37400 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXXTAYKPXXXAXXAPXIXXXXXGFXLKXXXX

SEQ ID NO: 37401 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXXTAYKPXXXAXXAPXIXXXXXTPAXXXXXXX

SEQ ID NO: 37402 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXXTAYKPXXXAXXAPXIXXXXXXAPWXX

SEQ ID NO: 37403 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXXTAYKPXXXAXXAPXIXXXPPXXXXPXX

SEQ ID NO: 37404 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXXTAYKPXXXAXXAPXIXXXXXXXXXXXX

SEQ ID NO: 37405 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXXTAYKPXXXAXXAPXIXXXFXPPAPXXX

SEQ ID NO: 37406 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXXTAYKPXXXAXXAPXIXXXDFTXFPPXX

SEQ ID NO: 37407 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXXTAYKPXXXAXXAPXIXXXXTPAXFXXX

SEQ ID NO: 37408 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXXTAYKPXXXAXXAPXIXXXXARXTPXSPPXX

SEQ ID NO: 37409 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXXTAYKPXXXAXXAPXIXXXXXTAYKPXXX

SEQ ID NO: 37410 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXXTAYKPXXXAXXAPXIXXXXAXXAPXIXXXX

SEQ ID NO: 37411 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (12)..(12): Xaa = Asn, Trp or Ala
  MISC_FEATURE (14)..(14): Xaa = Phe, Asn, Tyr or Pro
  MISC_FEATURE (15)..(15): Xaa = Pro, His, Tyr, Trp or Ala
  MISC_FEATURE (18)..(18): Xaa = Tyr or Ala
  MISC_FEATURE (20)..(20): Xaa = Trp or Gln
  MISC_FEATURE (21)..(21): Xaa = Arg or Gln
  MISC_FEATURE (22)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXXTAYKPXXXAXXAPXIXXXHXXQPXAQEPXX

SEQ ID NO: 37412 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXXTAYKPXXHXXQPXAQEPXXXGFXLKXXXX

SEQ ID NO: 37413 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXXTAYKPXXHXXQPXAQEPXXXTPAXXXXXXX

SEQ ID NO: 37414 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXXTAYKPXXHXXQPXAQEPXXXXAPWXX

SEQ ID NO: 37415 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXXTAYKPXXHXXQPXAQEPXPPXXXXPXX

SEQ ID NO: 37416 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXXTAYKPXXHXXQPXAQEPXXXXXXXXXX

SEQ ID NO: 37417 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXXTAYKPXXHXXQPXAQEPXFXPPAPXXX

SEQ ID NO: 37418 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXXTAYKPXXHXXQPXAQEPXDFTXFPPXX

SEQ ID NO: 37419 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXXTAYKPXXHXXQPXAQEPXXTPAXFXXX

SEQ ID NO: 37420 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXXTAYKPXXHXXQPXAQEPXXARXTPXSPPXX

SEQ ID NO: 37421 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXXTAYKPXXHXXQPXAQEPXXXTAYKPXXX

SEQ ID NO: 37422 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXXTAYKPXXHXXQPXAQEPXXAXXAPXIXXXX

SEQ ID NO: 37423 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(11): Xaa = any amino acid, non amino acid, or is absent
  MISC_FEATURE (13)..(13): Xaa = Glu, Gly, Trp or Phe
  MISC_FEATURE (14)..(14): Xaa = Gly, Ala or Asn
  MISC_FEATURE (17)..(17): Xaa = His, Trp or Lys
  MISC_FEATURE (22)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXXTAYKPXXHXXQPXAQEPXHXXQPXAQEPXX

SEQ ID NO: 37424 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXXAXXAPXIXXXXXGFXLKXXXXXGFXLKXXXX

SEQ ID NO: 37425 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXXAXXAPXIXXXXXGFXLKXXXXXTPAXXXXXXX

SEQ ID NO: 37426 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXXAXXAPXIXXXXXGFXLKXXXXXXAPWXX

SEQ ID NO: 37427 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXXAXXAPXIXXXXXGFXLKXXXPPXXXXPXX

SEQ ID NO: 37428 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXXAXXAPXIXXXXXGFXLKXXXXXXXXXXXX

SEQ ID NO: 37429 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXXAXXAPXIXXXXXGFXLKXXXFXPPAPXXX

SEQ ID NO: 37430 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXXAXXAPXIXXXXXGFXLKXXXDFTXFPPXX

SEQ ID NO: 37431 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXXAXXAPXIXXXXXGFXLKXXXXTPAXFXXX

SEQ ID NO: 37432 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXXAXXAPXIXXXXXGFXLKXXXXARXTPXSPPXX

SEQ ID NO: 37433 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXXAXXAPXIXXXXXGFXLKXXXXXTAYKPXXX

SEQ ID NO: 37434 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXXAXXAPXIXXXXXGFXLKXXXXAXXAPXIXXXX

SEQ ID NO: 37435 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXXAXXAPXIXXXXXGFXLKXXXHXXQPXAQEPXX

SEQ ID NO: 37436 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXAXXAPXIXXXXXTPAXXXXXXXXGFXLKXXXX

SEQ ID NO: 37437 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXAXXAPXIXXXXXTPAXXXXXXXXTPAXXXXXXX

SEQ ID NO: 37438 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXAXXAPXIXXXXXTPAXXXXXXXXXAPWXX

SEQ ID NO: 37439 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXAXXAPXIXXXXXTPAXXXXXXPPXXXXPXX

SEQ ID NO: 37440 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXAXXAPXIXXXXXTPAXXXXXXXXXXXXXXX

SEQ ID NO: 37441 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXAXXAPXIXXXXXTPAXXXXXXFXPPAPXXX

SEQ ID NO: 37442 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXAXXAPXIXXXXXTPAXXXXXXDFTXFPPXX

SEQ ID NO: 37443 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXAXXAPXIXXXXXTPAXXXXXXXTPAXFXXX

SEQ ID NO: 37444 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXAXXAPXIXXXXXTPAXXXXXXXARXTPXSPPXX

SEQ ID NO: 37445 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXAXXAPXIXXXXXTPAXXXXXXXXTAYKPXXX

SEQ ID NO: 37446 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXAXXAPXIXXXXXTPAXXXXXXXAXXAPXIXXXX

SEQ ID NO: 37447 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXAXXAPXIXXXXXTPAXXXXXXHXXQPXAQEPXX

SEQ ID NO: 37448 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXXAXXAPXIXXXXXXAPWXXXGFXLKXXXX

SEQ ID NO: 37449 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXXAXXAPXIXXXXXXAPWXXXTPAXXXXXXX

SEQ ID NO: 37450 - protein, 28 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXXAXXAPXIXXXXXXAPWXXXXAPWXX

SEQ ID NO: 37451 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXXAXXAPXIXXXXXXAPWXPPXXXXPXX

SEQ ID NO: 37452 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXXAXXAPXIXXXXXXAPWXXXXXXXXXX

SEQ ID NO: 37453 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXXAXXAPXIXXXXXXAPWXFXPPAPXXX

SEQ ID NO: 37454 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXXAXXAPXIXXXXXXAPWXDFTXFPPXX

SEQ ID NO: 37455 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXXAXXAPXIXXXXXXAPWXXTPAXFXXX

SEQ ID NO: 37456 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXXAXXAPXIXXXXXXAPWXXARXTPXSPPXX

SEQ ID NO: 37457 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXXAXXAPXIXXXXXXAPWXXXTAYKPXXX

SEQ ID NO: 37458 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXXAXXAPXIXXXXXXAPWXXAXXAPXIXXXX

SEQ ID NO: 37459 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXXAXXAPXIXXXXXXAPWXHXXQPXAQEPXX

SEQ ID NO: 37460 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXAXXAPXIXXXPPXXXXPXXXGFXLKXXXX

SEQ ID NO: 37461 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXAXXAPXIXXXPPXXXXPXXXTPAXXXXXXX

SEQ ID NO: 37462 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXAXXAPXIXXXPPXXXXPXXXXAPWXX

SEQ ID NO: 37463 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXAXXAPXIXXXPPXXXXPXPPXXXXPXX

SEQ ID NO: 37464 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXAXXAPXIXXXPPXXXXPXXXXXXXXXX

SEQ ID NO: 37465 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXAXXAPXIXXXPPXXXXPXFXPPAPXXX

SEQ ID NO: 37466 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXAXXAPXIXXXPPXXXXPXDFTXFPPXX

SEQ ID NO: 37467 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXAXXAPXIXXXPPXXXXPXXTPAXFXXX

SEQ ID NO: 37468 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXAXXAPXIXXXPPXXXXPXXARXTPXSPPXX

SEQ ID NO: 37469 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXAXXAPXIXXXPPXXXXPXXXTAYKPXXX

SEQ ID NO: 37470 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXAXXAPXIXXXPPXXXXPXXAXXAPXIXXXX

SEQ ID NO: 37471 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXAXXAPXIXXXPPXXXXPXHXXQPXAQEPXX

SEQ ID NO: 37472 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXAXXAPXIXXXXXXXXXXXXXGFXLKXXXX

SEQ ID NO: 37473 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXAXXAPXIXXXXXXXXXXXXXTPAXXXXXXX

SEQ ID NO: 37474 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXAXXAPXIXXXXXXXXXXXXXXAPWXX

SEQ ID NO: 37475 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXAXXAPXIXXXXXXXXXXXPPXXXXPXX

SEQ ID NO: 37476 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXAXXAPXIXXXXXXXXXXXXXXXXXXXX

SEQ ID NO: 37477 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXAXXAPXIXXXXXXXXXXXFXPPAPXXX

SEQ ID NO: 37478 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXAXXAPXIXXXXXXXXXXXDFTXFPPXX

SEQ ID NO: 37479 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXAXXAPXIXXXXXXXXXXXXTPAXFXXX

SEQ ID NO: 37480 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXAXXAPXIXXXXXXXXXXXXARXTPXSPPXX

SEQ ID NO: 37481 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXAXXAPXIXXXXXXXXXXXXXTAYKPXXX

SEQ ID NO: 37482 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXAXXAPXIXXXXXXXXXXXXAXXAPXIXXXX

SEQ ID NO: 37483 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXAXXAPXIXXXXXXXXXXXHXXQPXAQEPXX

SEQ ID NO: 37484 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXAXXAPXIXXXFXPPAPXXXXGFXLKXXXX

SEQ ID NO: 37485 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXAXXAPXIXXXFXPPAPXXXXTPAXXXXXXX

SEQ ID NO: 37486 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXAXXAPXIXXXFXPPAPXXXXXAPWXX

SEQ ID NO: 37487 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXAXXAPXIXXXFXPPAPXXPPXXXXPXX

SEQ ID NO: 37488 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXAXXAPXIXXXFXPPAPXXXXXXXXXXX

SEQ ID NO: 37489 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXAXXAPXIXXXFXPPAPXXFXPPAPXXX

SEQ ID NO: 37490 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXAXXAPXIXXXFXPPAPXXDFTXFPPXX

SEQ ID NO: 37491 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXAXXAPXIXXXFXPPAPXXXTPAXFXXX

SEQ ID NO: 37492 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXAXXAPXIXXXFXPPAPXXXARXTPXSPPXX

SEQ ID NO: 37493 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXAXXAPXIXXXFXPPAPXXXXTAYKPXXX

SEQ ID NO: 37494 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXAXXAPXIXXXFXPPAPXXXAXXAPXIXXXX

SEQ ID NO: 37495 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXAXXAPXIXXXFXPPAPXXHXXQPXAQEPXX

SEQ ID NO: 37496 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXAXXAPXIXXXDFTXFPPXXXGFXLKXXXX

SEQ ID NO: 37497 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXAXXAPXIXXXDFTXFPPXXXTPAXXXXXXX

SEQ ID NO: 37498 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXAXXAPXIXXXDFTXFPPXXXXAPWXX

SEQ ID NO: 37499 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXAXXAPXIXXXDFTXFPPXPPXXXXPXX

SEQ ID NO: 37500 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXAXXAPXIXXXDFTXFPPXXXXXXXXXX

SEQ ID NO: 37501 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXAXXAPXIXXXDFTXFPPXFXPPAPXXX

SEQ ID NO: 37502 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXAXXAPXIXXXDFTXFPPXDFTXFPPXX

SEQ ID NO: 37503 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXAXXAPXIXXXDFTXFPPXXTPAXFXXX

SEQ ID NO: 37504 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXAXXAPXIXXXDFTXFPPXXARXTPXSPPXX

SEQ ID NO: 37505 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXAXXAPXIXXXDFTXFPPXXXTAYKPXXX

SEQ ID NO: 37506 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXAXXAPXIXXXDFTXFPPXXAXXAPXIXXXX

SEQ ID NO: 37507 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXAXXAPXIXXXDFTXFPPXHXXQPXAQEPXX

SEQ ID NO: 37508 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXXAXXAPXIXXXXTPAXFXXXXGFXLKXXXX

SEQ ID NO: 37509 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXXAXXAPXIXXXXTPAXFXXXXTPAXXXXXXX

SEQ ID NO: 37510 - protein, 29 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXXAXXAPXIXXXXTPAXFXXXXXAPWXX

SEQ ID NO: 37511 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXXAXXAPXIXXXXTPAXFXXPPXXXXPXX

SEQ ID NO: 37512 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXXAXXAPXIXXXXTPAXFXXXXXXXXXXX

SEQ ID NO: 37513 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXXAXXAPXIXXXXTPAXFXXFXPPAPXXX

SEQ ID NO: 37514 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXXAXXAPXIXXXXTPAXFXXDFTXFPPXX

SEQ ID NO: 37515 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXXAXXAPXIXXXXTPAXFXXXTPAXFXXX

SEQ ID NO: 37516 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXXAXXAPXIXXXXTPAXFXXXARXTPXSPPXX

SEQ ID NO: 37517 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXXAXXAPXIXXXXTPAXFXXXXTAYKPXXX

SEQ ID NO: 37518 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXXAXXAPXIXXXXTPAXFXXXAXXAPXIXXXX

SEQ ID NO: 37519 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXXAXXAPXIXXXXTPAXFXXHXXQPXAQEPXX

SEQ ID NO: 37520 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXAXXAPXIXXXXARXTPXSPPXXXGFXLKXXXX

SEQ ID NO: 37521 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXAXXAPXIXXXXARXTPXSPPXXXTPAXXXXXXX

SEQ ID NO: 37522 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXAXXAPXIXXXXARXTPXSPPXXXXAPWXX

SEQ ID NO: 37523 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXAXXAPXIXXXXARXTPXSPPXPPXXXXPXX

SEQ ID NO: 37524 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXAXXAPXIXXXXARXTPXSPPXXXXXXXXXX

SEQ ID NO: 37525 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXAXXAPXIXXXXARXTPXSPPXFXPPAPXXX

SEQ ID NO: 37526 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXAXXAPXIXXXXARXTPXSPPXDFTXFPPXX

SEQ ID NO: 37527 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXAXXAPXIXXXXARXTPXSPPXXTPAXFXXX

SEQ ID NO: 37528 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXAXXAPXIXXXXARXTPXSPPXXARXTPXSPPXX

SEQ ID NO: 37529 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXAXXAPXIXXXXARXTPXSPPXXXTAYKPXXX

SEQ ID NO: 37530 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXAXXAPXIXXXXARXTPXSPPXXAXXAPXIXXXX

SEQ ID NO: 37531 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXAXXAPXIXXXXARXTPXSPPXHXXQPXAQEPXX

SEQ ID NO: 37532 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXXAXXAPXIXXXXXTAYKPXXXXGFXLKXXXX

SEQ ID NO: 37533 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXXAXXAPXIXXXXXTAYKPXXXXTPAXXXXXXX

SEQ ID NO: 37534 - protein, 30 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXXAXXAPXIXXXXXTAYKPXXXXXAPWXX

SEQ ID NO: 37535 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXXAXXAPXIXXXXXTAYKPXXPPXXXXPXX

SEQ ID NO: 37536 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXXAXXAPXIXXXXXTAYKPXXXXXXXXXXX

SEQ ID NO: 37537 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXXAXXAPXIXXXXXTAYKPXXFXPPAPXXX

SEQ ID NO: 37538 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXXAXXAPXIXXXXXTAYKPXXDFTXFPPXX

SEQ ID NO: 37539 - protein, 31 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXXAXXAPXIXXXXXTAYKPXXXTPAXFXXX

SEQ ID NO: 37540 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXXAXXAPXIXXXXXTAYKPXXXARXTPXSPPXX

SEQ ID NO: 37541 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXXAXXAPXIXXXXXTAYKPXXXXTAYKPXXX

SEQ ID NO: 37542 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXXAXXAPXIXXXXXTAYKPXXXAXXAPXIXXXX

SEQ ID NO: 37543 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXXAXXAPXIXXXXXTAYKPXXHXXQPXAQEPXX

SEQ ID NO: 37544 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXAXXAPXIXXXXAXXAPXIXXXXXGFXLKXXXX

SEQ ID NO: 37545 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXAXXAPXIXXXXAXXAPXIXXXXXTPAXXXXXXX

SEQ ID NO: 37546 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXAXXAPXIXXXXAXXAPXIXXXXXXAPWXX

SEQ ID NO: 37547 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXAXXAPXIXXXXAXXAPXIXXXPPXXXXPXX

SEQ ID NO: 37548 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXAXXAPXIXXXXAXXAPXIXXXXXXXXXXXX

SEQ ID NO: 37549 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXAXXAPXIXXXXAXXAPXIXXXFXPPAPXXX

SEQ ID NO: 37550 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXAXXAPXIXXXXAXXAPXIXXXDFTXFPPXX

SEQ ID NO: 37551 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXAXXAPXIXXXXAXXAPXIXXXXTPAXFXXX

SEQ ID NO: 37552 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXAXXAPXIXXXXAXXAPXIXXXXARXTPXSPPXX

SEQ ID NO: 37553 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXAXXAPXIXXXXAXXAPXIXXXXXTAYKPXXX

SEQ ID NO: 37554 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXAXXAPXIXXXXAXXAPXIXXXXAXXAPXIXXXX

SEQ ID NO: 37555 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXAXXAPXIXXXXAXXAPXIXXXHXXQPXAQEPXX

SEQ ID NO: 37556 - protein, 35 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXXAXXAPXIXXXHXXQPXAQEPXXXGFXLKXXXX

SEQ ID NO: 37557 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXXAXXAPXIXXXHXXQPXAQEPXXXTPAXXXXXXX

SEQ ID NO: 37558 - protein, 32 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXXAXXAPXIXXXHXXQPXAQEPXXXXAPWXX

SEQ ID NO: 37559 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXXAXXAPXIXXXHXXQPXAQEPXPPXXXXPXX

SEQ ID NO: 37560 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXXAXXAPXIXXXHXXQPXAQEPXXXXXXXXXX

SEQ ID NO: 37561 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXXAXXAPXIXXXHXXQPXAQEPXFXPPAPXXX

SEQ ID NO: 37562 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXXAXXAPXIXXXHXXQPXAQEPXDFTXFPPXX

SEQ ID NO: 37563 - protein, 33 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXXAXXAPXIXXXHXXQPXAQEPXXTPAXFXXX

SEQ ID NO: 37564 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXXAXXAPXIXXXHXXQPXAQEPXXARXTPXSPPXX

SEQ ID NO: 37565 - protein, 34 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXXAXXAPXIXXXHXXQPXAQEPXXXTAYKPXXX

SEQ ID NO: 37566 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXXAXXAPXIXXXHXXQPXAQEPXXAXXAPXIXXXX

SEQ ID NO: 37567 - protein, 36 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXXAXXAPXIXXXHXXQPXAQEPXHXXQPXAQEPXX

SEQ ID NO: 37568 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (28)..(28): Xaa = any amino acid, non amino acid, or is absent
  MISC_FEATURE (31)..(34): Xaa = any amino acid, non amino acid, or is absent
XXHXXQPXAQEPXXXGFXLKXXXXXGFXLKXXXX

SEQ ID NO: 37569 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(25): Xaa = any amino acid, non amino acid, or is absent
  MISC_FEATURE (29)..(29): Xaa = Asn or Asp
  MISC_FEATURE (30)..(30): Xaa = Asn or Glu
  MISC_FEATURE (31)..(35): Xaa = any amino acid, non amino acid, or is absent
XXHXXQPXAQEPXXXGFXLKXXXXXTPAXXXXXXX

SEQ ID NO: 37570 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Ile, Phe, Trp, Tyr or Ala
  MISC_FEATURE (25)..(25): Xaa = Asp, Ala, Gln, Glu, Gly, His, Ile, Leu, Phe, Pro, Thr or Tyr
  MISC_FEATURE (26)..(26): Xaa = Gln, Leu, Trp or Tyr
  MISC_FEATURE (30)..(31): Xaa = any amino acid, non amino acid, or is absent
XXHXXQPXAQEPXXXGFXLKXXXXXXAPWXX

SEQ ID NO: 37571 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (26)..(26): Xaa = Tyr or Pro
  MISC_FEATURE (27)..(27): Xaa = Trp, Tyr, Phe, Ala, Val, Cys, Thr, Leu, Ser, His, Gln, Glu, Gly or Ile
  MISC_FEATURE (28)..(28): Xaa = Trp, Ile, Phe, Pro, Asp, Gly, Cys or Ala
  MISC_FEATURE (29)..(29): Xaa = Gly or Asn
  MISC_FEATURE (31)..(32): Xaa = any amino acid, non amino acid, or is absent
XXHXXQPXAQEPXXXGFXLKXXXPPXXXXPXX

SEQ ID NO: 37572 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Gly, Tyr or Trp
  MISC_FEATURE (25)..(25): Xaa = Trp, Val, Ile, Phe, Arg, Met, Ser or Leu
  MISC_FEATURE (26)..(26): Xaa = Ile or Gly
  MISC_FEATURE (27)..(27): Xaa = Tyr, Pro, His, Leu or Phe
  MISC_FEATURE (28)..(28): Xaa = Ile, Asp, Tyr, Phe, Val, Thr, Gly, Ala or Gln
  MISC_FEATURE (29)..(29): Xaa = Phe, Arg, Cys, Leu, Ala, Gln, Asp or Val
  MISC_FEATURE (30)..(30): Xaa = Phe or Tyr
  MISC_FEATURE (31)..(32): Xaa = any amino acid, non amino acid, or is absent
XXHXXQPXAQEPXXXGFXLKXXXXXXXXXXXX

SEQ ID NO: 37573 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Pro or Ser
  MISC_FEATURE (30)..(30): Xaa = Pro, Tyr, Leu, Ala, Glu, Gly, Val or Ile
  MISC_FEATURE (31)..(32): Xaa = any amino acid, non amino acid, or is absent
XXHXXQPXAQEPXXXGFXLKXXXFXPPAPXXX

SEQ ID NO: 37574 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (27)..(27): Xaa = Val or Ile
  MISC_FEATURE (31)..(32): Xaa = any amino acid, non amino acid, or is absent
XXHXXQPXAQEPXXXGFXLKXXXDFTXFPPXX

SEQ ID NO: 37575 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Tyr, Thr or His
  MISC_FEATURE (28)..(28): Xaa = His or Ile
  MISC_FEATURE (30)..(30): Xaa = Tyr or Ala
  MISC_FEATURE (31)..(32): Xaa = any amino acid, non amino acid, or is absent
XXHXXQPXAQEPXXXGFXLKXXXXTPAXFXXX

SEQ ID NO: 37576 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Pro or Ala
  MISC_FEATURE (27)..(27): Xaa = Ala, Pro, Trp, Asn or Leu
  MISC_FEATURE (30)..(30): Xaa = Pro or Phe
  MISC_FEATURE (34)..(35): Xaa = any amino acid, non amino acid, or is absent
XXHXXQPXAQEPXXXGFXLKXXXXARXTPXSPPXX

SEQ ID NO: 37577 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Trp or Leu
  MISC_FEATURE (25)..(25): Xaa = Ala, Asn, Ser, Trp or Glu
  MISC_FEATURE (31)..(31): Xaa = Ser or Phe
  MISC_FEATURE (32)..(33): Xaa = any amino acid, non amino acid, or is absent
XXHXXQPXAQEPXXXGFXLKXXXXXTAYKPXXX

SEQ ID NO: 37578 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (24)..(24): Xaa = Asn, Trp or Ala
  MISC_FEATURE (26)..(26): Xaa = Phe, Asn, Tyr or Pro
  MISC_FEATURE (27)..(27): Xaa = Pro, His, Tyr, Trp or Ala
  MISC_FEATURE (30)..(30): Xaa = Tyr or Ala
  MISC_FEATURE (32)..(32): Xaa = Trp or Gln
  MISC_FEATURE (33)..(33): Xaa = Arg or Gln
  MISC_FEATURE (34)..(35): Xaa = any amino acid, non amino acid, or is absent
XXHXXQPXAQEPXXXGFXLKXXXXAXXAPXIXXXX

SEQ ID NO: 37579 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (18)..(18): Xaa = any amino acid, non amino acid, or is absent
  MISC_FEATURE (21)..(23): Xaa = any amino acid, non amino acid, or is absent
  MISC_FEATURE (25)..(25): Xaa = Glu, Gly, Trp or Phe
  MISC_FEATURE (26)..(26): Xaa = Gly, Ala or Asn
  MISC_FEATURE (29)..(29): Xaa = His, Trp or Lys
  MISC_FEATURE (34)..(35): Xaa = any amino acid, non amino acid, or is absent
XXHXXQPXAQEPXXXGFXLKXXXHXXQPXAQEPXX

SEQ ID NO: 37580 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXHXXQPXAQEPXXXTPAXXXXXXXXGFXLKXXXX

SEQ ID NO: 37581 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXHXXQPXAQEPXXXTPAXXXXXXXXTPAXXXXXXX

SEQ ID NO: 37582 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXHXXQPXAQEPXXXTPAXXXXXXXXXAPWXX

SEQ ID NO: 37583 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXHXXQPXAQEPXXXTPAXXXXXXPPXXXXPXX

SEQ ID NO: 37584 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXHXXQPXAQEPXXXTPAXXXXXXXXXXXXXXX

SEQ ID NO: 37585 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXHXXQPXAQEPXXXTPAXXXXXXFXPPAPXXX

SEQ ID NO: 37586 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXHXXQPXAQEPXXXTPAXXXXXXDFTXFPPXX

SEQ ID NO: 37587 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXHXXQPXAQEPXXXTPAXXXXXXXTPAXFXXX

SEQ ID NO: 37588 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXHXXQPXAQEPXXXTPAXXXXXXXARXTPXSPPXX

SEQ ID NO: 37589 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXHXXQPXAQEPXXXTPAXXXXXXXXTAYKPXXX

SEQ ID NO: 37590 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXHXXQPXAQEPXXXTPAXXXXXXXAXXAPXIXXXX

SEQ ID NO: 37591 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(15): Xaa = any amino acid, non amino acid, or is absent
  MISC_FEATURE (19)..(19): Xaa = Asn or Asp
  MISC_FEATURE (20)..(20): Xaa = Asn or Glu
  MISC_FEATURE (21)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXHXXQPXAQEPXXXTPAXXXXXXHXXQPXAQEPXX

SEQ ID NO: 37592 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (25)..(25): Xaa = any amino acid, non amino acid, or is absent
  MISC_FEATURE (28)..(31): Xaa = any amino acid, non amino acid, or is absent
XXHXXQPXAQEPXXXXAPWXXXGFXLKXXXX

SEQ ID NO: 37593 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(22): Xaa = any amino acid, non amino acid, or is absent
  MISC_FEATURE (26)..(26): Xaa = Asn or Asp
  MISC_FEATURE (27)..(27): Xaa = Asn or Glu
  MISC_FEATURE (28)..(32): Xaa = any amino acid, non amino acid, or is absent
XXHXXQPXAQEPXXXXAPWXXXTPAXXXXXXX

SEQ ID NO: 37594 - protein, 28 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Ile, Phe, Trp, Tyr or Ala
  MISC_FEATURE (22)..(22): Xaa = Asp, Ala, Gln, Glu, Gly, His, Ile, Leu, Phe, Pro, Thr or Tyr
  MISC_FEATURE (23)..(23): Xaa = Gln, Leu, Trp or Tyr
  MISC_FEATURE (27)..(28): Xaa = any amino acid, non amino acid, or is absent
XXHXXQPXAQEPXXXXAPWXXXXAPWXX

SEQ ID NO: 37595 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (23)..(23): Xaa = Tyr or Pro
  MISC_FEATURE (24)..(24): Xaa = Trp, Tyr, Phe, Ala, Val, Cys, Thr, Leu, Ser, His, Gln, Glu, Gly or Ile
  MISC_FEATURE (25)..(25): Xaa = Trp, Ile, Phe, Pro, Asp, Gly, Cys or Ala
  MISC_FEATURE (26)..(26): Xaa = Gly or Asn
  MISC_FEATURE (28)..(29): Xaa = any amino acid, non amino acid, or is absent
XXHXXQPXAQEPXXXXAPWXPPXXXXPXX

SEQ ID NO: 37596 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Gly, Tyr or Trp
  MISC_FEATURE (22)..(22): Xaa = Trp, Val, Ile, Phe, Arg, Met, Ser or Leu
  MISC_FEATURE (23)..(23): Xaa = Ile or Gly
  MISC_FEATURE (24)..(24): Xaa = Tyr, Pro, His, Leu or Phe
  MISC_FEATURE (25)..(25): Xaa = Ile, Asp, Tyr, Phe, Val, Thr, Gly, Ala or Gln
  MISC_FEATURE (26)..(26): Xaa = Phe, Arg, Cys, Leu, Ala, Gln, Asp or Val
  MISC_FEATURE (27)..(27): Xaa = Phe or Tyr
  MISC_FEATURE (28)..(29): Xaa = any amino acid, non amino acid, or is absent
XXHXXQPXAQEPXXXXAPWXXXXXXXXXX

SEQ ID NO: 37597 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Pro or Ser
  MISC_FEATURE (27)..(27): Xaa = Pro, Tyr, Leu, Ala, Glu, Gly, Val or Ile
  MISC_FEATURE (28)..(29): Xaa = any amino acid, non amino acid, or is absent
XXHXXQPXAQEPXXXXAPWXFXPPAPXXX

SEQ ID NO: 37598 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (24)..(24): Xaa = Val or Ile
  MISC_FEATURE (28)..(29): Xaa = any amino acid, non amino acid, or is absent
XXHXXQPXAQEPXXXXAPWXDFTXFPPXX

SEQ ID NO: 37599 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Tyr, Thr or His
  MISC_FEATURE (25)..(25): Xaa = His or Ile
  MISC_FEATURE (27)..(27): Xaa = Tyr or Ala
  MISC_FEATURE (28)..(29): Xaa = any amino acid, non amino acid, or is absent
XXHXXQPXAQEPXXXXAPWXXTPAXFXXX

SEQ ID NO: 37600 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Pro or Ala
  MISC_FEATURE (24)..(24): Xaa = Ala, Pro, Trp, Asn or Leu
  MISC_FEATURE (27)..(27): Xaa = Pro or Phe
  MISC_FEATURE (31)..(32): Xaa = any amino acid, non amino acid, or is absent
XXHXXQPXAQEPXXXXAPWXXARXTPXSPPXX

SEQ ID NO: 37601 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Trp or Leu
  MISC_FEATURE (22)..(22): Xaa = Ala, Asn, Ser, Trp or Glu
  MISC_FEATURE (28)..(28): Xaa = Ser or Phe
  MISC_FEATURE (29)..(30): Xaa = any amino acid, non amino acid, or is absent
XXHXXQPXAQEPXXXXAPWXXXTAYKPXXX

SEQ ID NO: 37602 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (21)..(21): Xaa = Asn, Trp or Ala
  MISC_FEATURE (23)..(23): Xaa = Phe, Asn, Tyr or Pro
  MISC_FEATURE (24)..(24): Xaa = Pro, His, Tyr, Trp or Ala
  MISC_FEATURE (27)..(27): Xaa = Tyr or Ala
  MISC_FEATURE (29)..(29): Xaa = Trp or Gln
  MISC_FEATURE (30)..(30): Xaa = Arg or Gln
  MISC_FEATURE (31)..(32): Xaa = any amino acid, non amino acid, or is absent
XXHXXQPXAQEPXXXXAPWXXAXXAPXIXXXX

SEQ ID NO: 37603 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Ile, Phe, Trp, Tyr or Ala
  MISC_FEATURE (15)..(15): Xaa = Asp, Ala, Gln, Glu, Gly, His, Ile, Leu, Phe, Pro, Thr or Tyr
  MISC_FEATURE (16)..(16): Xaa = Gln, Leu, Trp or Tyr
  MISC_FEATURE (20)..(20): Xaa = any amino acid, non amino acid, or is absent
  MISC_FEATURE (22)..(22): Xaa = Glu, Gly, Trp or Phe
  MISC_FEATURE (23)..(23): Xaa = Gly, Ala or Asn
  MISC_FEATURE (26)..(26): Xaa = His, Trp or Lys
  MISC_FEATURE (31)..(32): Xaa = any amino acid, non amino acid, or is absent
XXHXXQPXAQEPXXXXAPWXHXXQPXAQEPXX

SEQ ID NO: 37604 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXHXXQPXAQEPXPPXXXXPXXXGFXLKXXXX

SEQ ID NO: 37605 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXHXXQPXAQEPXPPXXXXPXXXTPAXXXXXXX

SEQ ID NO: 37606 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXHXXQPXAQEPXPPXXXXPXXXXAPWXX

SEQ ID NO: 37607 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXHXXQPXAQEPXPPXXXXPXPPXXXXPXX

SEQ ID NO: 37608 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXHXXQPXAQEPXPPXXXXPXXXXXXXXXX

SEQ ID NO: 37609 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXHXXQPXAQEPXPPXXXXPXFXPPAPXXX

SEQ ID NO: 37610 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXHXXQPXAQEPXPPXXXXPXDFTXFPPXX

SEQ ID NO: 37611 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXHXXQPXAQEPXPPXXXXPXXTPAXFXXX

SEQ ID NO: 37612 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXHXXQPXAQEPXPPXXXXPXXARXTPXSPPXX

SEQ ID NO: 37613 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXHXXQPXAQEPXPPXXXXPXXXTAYKPXXX

SEQ ID NO: 37614 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXHXXQPXAQEPXPPXXXXPXXAXXAPXIXXXX

SEQ ID NO: 37615 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (16)..(16): Xaa = Tyr or Pro
  MISC_FEATURE (17)..(17): Xaa = Trp, Tyr, Phe, Ala, Val, Cys, Thr, Leu, Ser, His, Gln, Glu, Gly or Ile
  MISC_FEATURE (18)..(18): Xaa = Trp, Ile, Phe, Pro, Asp, Gly, Cys or Ala
  MISC_FEATURE (19)..(19): Xaa = Gly or Asn
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXHXXQPXAQEPXPPXXXXPXHXXQPXAQEPXX

SEQ ID NO: 37616 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXHXXQPXAQEPXXXXXXXXXXXGFXLKXXXX

SEQ ID NO: 37617 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXHXXQPXAQEPXXXXXXXXXXXTPAXXXXXXX

SEQ ID NO: 37618 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXHXXQPXAQEPXXXXXXXXXXXXAPWXX

SEQ ID NO: 37619 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXHXXQPXAQEPXXXXXXXXXPPXXXXPXX

SEQ ID NO: 37620 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXHXXQPXAQEPXXXXXXXXXXXXXXXXXX

SEQ ID NO: 37621 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXHXXQPXAQEPXXXXXXXXXFXPPAPXXX

SEQ ID NO: 37622 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXHXXQPXAQEPXXXXXXXXXDFTXFPPXX

SEQ ID NO: 37623 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXHXXQPXAQEPXXXXXXXXXXTPAXFXXX

SEQ ID NO: 37624 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXHXXQPXAQEPXXXXXXXXXXARXTPXSPPXX

SEQ ID NO: 37625 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXHXXQPXAQEPXXXXXXXXXXXTAYKPXXX

SEQ ID NO: 37626 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXHXXQPXAQEPXXXXXXXXXXAXXAPXIXXXX

SEQ ID NO: 37627 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Gly, Tyr or Trp
  MISC_FEATURE (15)..(15): Xaa = Trp, Val, Ile, Phe, Arg, Met, Ser or Leu
  MISC_FEATURE (16)..(16): Xaa = Ile or Gly
  MISC_FEATURE (17)..(17): Xaa = Tyr, Pro, His, Leu or Phe
  MISC_FEATURE (18)..(18): Xaa = Ile, Asp, Tyr, Phe, Val, Thr, Gly, Ala or Gln
  MISC_FEATURE (19)..(19): Xaa = Phe, Arg, Cys, Leu, Ala, Gln, Asp or Val
  MISC_FEATURE (20)..(20): Xaa = Phe or Tyr
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXHXXQPXAQEPXXXXXXXXXHXXQPXAQEPXX

SEQ ID NO: 37628 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXHXXQPXAQEPXFXPPAPXXXXGFXLKXXXX

SEQ ID NO: 37629 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXHXXQPXAQEPXFXPPAPXXXXTPAXXXXXXX

SEQ ID NO: 37630 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXHXXQPXAQEPXFXPPAPXXXXXAPWXX

SEQ ID NO: 37631 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXHXXQPXAQEPXFXPPAPXXPPXXXXPXX

SEQ ID NO: 37632 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXHXXQPXAQEPXFXPPAPXXXXXXXXXXX

SEQ ID NO: 37633 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXHXXQPXAQEPXFXPPAPXXFXPPAPXXX

SEQ ID NO: 37634 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXHXXQPXAQEPXFXPPAPXXDFTXFPPXX

SEQ ID NO: 37635 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXHXXQPXAQEPXFXPPAPXXXTPAXFXXX

SEQ ID NO: 37636 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXHXXQPXAQEPXFXPPAPXXXARXTPXSPPXX

SEQ ID NO: 37637 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXHXXQPXAQEPXFXPPAPXXXXTAYKPXXX

SEQ ID NO: 37638 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXHXXQPXAQEPXFXPPAPXXXAXXAPXIXXXX

SEQ ID NO: 37639 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Pro or Ser
  MISC_FEATURE (20)..(20): Xaa = Pro, Tyr, Leu, Ala, Glu, Gly, Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXHXXQPXAQEPXFXPPAPXXHXXQPXAQEPXX

SEQ ID NO: 37640 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXHXXQPXAQEPXDFTXFPPXXXGFXLKXXXX

SEQ ID NO: 37641 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXHXXQPXAQEPXDFTXFPPXXXTPAXXXXXXX

SEQ ID NO: 37642 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXHXXQPXAQEPXDFTXFPPXXXXAPWXX

SEQ ID NO: 37643 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXHXXQPXAQEPXDFTXFPPXPPXXXXPXX

SEQ ID NO: 37644 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXHXXQPXAQEPXDFTXFPPXXXXXXXXXX

SEQ ID NO: 37645 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXHXXQPXAQEPXDFTXFPPXFXPPAPXXX

SEQ ID NO: 37646 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXHXXQPXAQEPXDFTXFPPXDFTXFPPXX

SEQ ID NO: 37647 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXHXXQPXAQEPXDFTXFPPXXTPAXFXXX

SEQ ID NO: 37648 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXHXXQPXAQEPXDFTXFPPXXARXTPXSPPXX

SEQ ID NO: 37649 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXHXXQPXAQEPXDFTXFPPXXXTAYKPXXX

SEQ ID NO: 37650 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXHXXQPXAQEPXDFTXFPPXXAXXAPXIXXXX

SEQ ID NO: 37651 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (17)..(17): Xaa = Val or Ile
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXHXXQPXAQEPXDFTXFPPXHXXQPXAQEPXX

SEQ ID NO: 37652 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (26)..(26): Xaa = any amino acid, non amino acid, or is absent
  MISC_FEATURE (29)..(32): Xaa = any amino acid, non amino acid, or is absent
XXHXXQPXAQEPXXTPAXFXXXXGFXLKXXXX

SEQ ID NO: 37653 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(23): Xaa = any amino acid, non amino acid, or is absent
  MISC_FEATURE (27)..(27): Xaa = Asn or Asp
  MISC_FEATURE (28)..(28): Xaa = Asn or Glu
  MISC_FEATURE (29)..(33): Xaa = any amino acid, non amino acid, or is absent
XXHXXQPXAQEPXXTPAXFXXXXTPAXXXXXXX

SEQ ID NO: 37654 - protein, 29 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Ile, Phe, Trp, Tyr or Ala
  MISC_FEATURE (23)..(23): Xaa = Asp, Ala, Gln, Glu, Gly, His, Ile, Leu, Phe, Pro, Thr or Tyr
  MISC_FEATURE (24)..(24): Xaa = Gln, Leu, Trp or Tyr
  MISC_FEATURE (28)..(29): Xaa = any amino acid, non amino acid, or is absent
XXHXXQPXAQEPXXTPAXFXXXXXAPWXX

SEQ ID NO: 37655 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (24)..(24): Xaa = Tyr or Pro
  MISC_FEATURE (25)..(25): Xaa = Trp, Tyr, Phe, Ala, Val, Cys, Thr, Leu, Ser, His, Gln, Glu, Gly or Ile
  MISC_FEATURE (26)..(26): Xaa = Trp, Ile, Phe, Pro, Asp, Gly, Cys or Ala
  MISC_FEATURE (27)..(27): Xaa = Gly or Asn
  MISC_FEATURE (29)..(30): Xaa = any amino acid, non amino acid, or is absent
XXHXXQPXAQEPXXTPAXFXXPPXXXXPXX

SEQ ID NO: 37656 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Gly, Tyr or Trp
  MISC_FEATURE (23)..(23): Xaa = Trp, Val, Ile, Phe, Arg, Met, Ser or Leu
  MISC_FEATURE (24)..(24): Xaa = Ile or Gly
  MISC_FEATURE (25)..(25): Xaa = Tyr, Pro, His, Leu or Phe
  MISC_FEATURE (26)..(26): Xaa = Ile, Asp, Tyr, Phe, Val, Thr, Gly, Ala or Gln
  MISC_FEATURE (27)..(27): Xaa = Phe, Arg, Cys, Leu, Ala, Gln, Asp or Val
  MISC_FEATURE (28)..(28): Xaa = Phe or Tyr
  MISC_FEATURE (29)..(30): Xaa = any amino acid, non amino acid, or is absent
XXHXXQPXAQEPXXTPAXFXXXXXXXXXXX

SEQ ID NO: 37657 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Pro or Ser
  MISC_FEATURE (28)..(28): Xaa = Pro, Tyr, Leu, Ala, Glu, Gly, Val or Ile
  MISC_FEATURE (29)..(30): Xaa = any amino acid, non amino acid, or is absent
XXHXXQPXAQEPXXTPAXFXXFXPPAPXXX

SEQ ID NO: 37658 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (25)..(25): Xaa = Val or Ile
  MISC_FEATURE (29)..(30): Xaa = any amino acid, non amino acid, or is absent
XXHXXQPXAQEPXXTPAXFXXDFTXFPPXX

SEQ ID NO: 37659 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Tyr, Thr or His
  MISC_FEATURE (26)..(26): Xaa = His or Ile
  MISC_FEATURE (28)..(28): Xaa = Tyr or Ala
  MISC_FEATURE (29)..(30): Xaa = any amino acid, non amino acid, or is absent
XXHXXQPXAQEPXXTPAXFXXXTPAXFXXX

SEQ ID NO: 37660 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Pro or Ala
  MISC_FEATURE (25)..(25): Xaa = Ala, Pro, Trp, Asn or Leu
  MISC_FEATURE (28)..(28): Xaa = Pro or Phe
  MISC_FEATURE (32)..(33): Xaa = any amino acid, non amino acid, or is absent
XXHXXQPXAQEPXXTPAXFXXXARXTPXSPPXX

SEQ ID NO: 37661 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Trp or Leu
  MISC_FEATURE (23)..(23): Xaa = Ala, Asn, Ser, Trp or Glu
  MISC_FEATURE (29)..(29): Xaa = Ser or Phe
  MISC_FEATURE (30)..(31): Xaa = any amino acid, non amino acid, or is absent
XXHXXQPXAQEPXXTPAXFXXXXTAYKPXXX

SEQ ID NO: 37662 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (22)..(22): Xaa = Asn, Trp or Ala
  MISC_FEATURE (24)..(24): Xaa = Phe, Asn, Tyr or Pro
  MISC_FEATURE (25)..(25): Xaa = Pro, His, Tyr, Trp or Ala
  MISC_FEATURE (28)..(28): Xaa = Tyr or Ala
  MISC_FEATURE (30)..(30): Xaa = Trp or Gln
  MISC_FEATURE (31)..(31): Xaa = Arg or Gln
  MISC_FEATURE (32)..(33): Xaa = any amino acid, non amino acid, or is absent
XXHXXQPXAQEPXXTPAXFXXXAXXAPXIXXXX

SEQ ID NO: 37663 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Tyr, Thr or His
  MISC_FEATURE (18)..(18): Xaa = His or Ile
  MISC_FEATURE (20)..(20): Xaa = Tyr or Ala
  MISC_FEATURE (21)..(21): Xaa = any amino acid, non amino acid, or is absent
  MISC_FEATURE (23)..(23): Xaa = Glu, Gly, Trp or Phe
  MISC_FEATURE (24)..(24): Xaa = Gly, Ala or Asn
  MISC_FEATURE (27)..(27): Xaa = His, Trp or Lys
  MISC_FEATURE (32)..(33): Xaa = any amino acid, non amino acid, or is absent
XXHXXQPXAQEPXXTPAXFXXHXXQPXAQEPXX

SEQ ID NO: 37664 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXHXXQPXAQEPXXARXTPXSPPXXXGFXLKXXXX

SEQ ID NO: 37665 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXHXXQPXAQEPXXARXTPXSPPXXXTPAXXXXXXX

SEQ ID NO: 37666 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXHXXQPXAQEPXXARXTPXSPPXXXXAPWXX

SEQ ID NO: 37667 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXHXXQPXAQEPXXARXTPXSPPXPPXXXXPXX

SEQ ID NO: 37668 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXHXXQPXAQEPXXARXTPXSPPXXXXXXXXXX

SEQ ID NO: 37669 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXHXXQPXAQEPXXARXTPXSPPXFXPPAPXXX

SEQ ID NO: 37670 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXHXXQPXAQEPXXARXTPXSPPXDFTXFPPXX

SEQ ID NO: 37671 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXHXXQPXAQEPXXARXTPXSPPXXTPAXFXXX

SEQ ID NO: 37672 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXHXXQPXAQEPXXARXTPXSPPXXARXTPXSPPXX

SEQ ID NO: 37673 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXHXXQPXAQEPXXARXTPXSPPXXXTAYKPXXX

SEQ ID NO: 37674 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXHXXQPXAQEPXXARXTPXSPPXXAXXAPXIXXXX

SEQ ID NO: 37675 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Pro or Ala
  MISC_FEATURE (17)..(17): Xaa = Ala, Pro, Trp, Asn or Leu
  MISC_FEATURE (20)..(20): Xaa = Pro or Phe
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXHXXQPXAQEPXXARXTPXSPPXHXXQPXAQEPXX

SEQ ID NO: 37676 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (27)..(27): Xaa = any amino acid, non amino acid, or is absent
  MISC_FEATURE (30)..(33): Xaa = any amino acid, non amino acid, or is absent
XXHXXQPXAQEPXXXTAYKPXXXXGFXLKXXXX

SEQ ID NO: 37677 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(24): Xaa = any amino acid, non amino acid, or is absent
  MISC_FEATURE (28)..(28): Xaa = Asn or Asp
  MISC_FEATURE (29)..(29): Xaa = Asn or Glu
  MISC_FEATURE (30)..(34): Xaa = any amino acid, non amino acid, or is absent
XXHXXQPXAQEPXXXTAYKPXXXXTPAXXXXXXX

SEQ ID NO: 37678 - protein, 30 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Ile, Phe, Trp, Tyr or Ala
  MISC_FEATURE (24)..(24): Xaa = Asp, Ala, Gln, Glu, Gly, His, Ile, Leu, Phe, Pro, Thr or Tyr
  MISC_FEATURE (25)..(25): Xaa = Gln, Leu, Trp or Tyr
  MISC_FEATURE (29)..(30): Xaa = any amino acid, non amino acid, or is absent
XXHXXQPXAQEPXXXTAYKPXXXXXAPWXX

SEQ ID NO: 37679 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (25)..(25): Xaa = Tyr or Pro
  MISC_FEATURE (26)..(26): Xaa = Trp, Tyr, Phe, Ala, Val, Cys, Thr, Leu, Ser, His, Gln, Glu, Gly or Ile
  MISC_FEATURE (27)..(27): Xaa = Trp, Ile, Phe, Pro, Asp, Gly, Cys or Ala
  MISC_FEATURE (28)..(28): Xaa = Gly or Asn
  MISC_FEATURE (30)..(31): Xaa = any amino acid, non amino acid, or is absent
XXHXXQPXAQEPXXXTAYKPXXPPXXXXPXX

SEQ ID NO: 37680 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Gly, Tyr or Trp
  MISC_FEATURE (24)..(24): Xaa = Trp, Val, Ile, Phe, Arg, Met, Ser or Leu
  MISC_FEATURE (25)..(25): Xaa = Ile or Gly
  MISC_FEATURE (26)..(26): Xaa = Tyr, Pro, His, Leu or Phe
  MISC_FEATURE (27)..(27): Xaa = Ile, Asp, Tyr, Phe, Val, Thr, Gly, Ala or Gln
  MISC_FEATURE (28)..(28): Xaa = Phe, Arg, Cys, Leu, Ala, Gln, Asp or Val
  MISC_FEATURE (29)..(29): Xaa = Phe or Tyr
  MISC_FEATURE (30)..(31): Xaa = any amino acid, non amino acid, or is absent
XXHXXQPXAQEPXXXTAYKPXXXXXXXXXXX

SEQ ID NO: 37681 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Pro or Ser
  MISC_FEATURE (29)..(29): Xaa = Pro, Tyr, Leu, Ala, Glu, Gly, Val or Ile
  MISC_FEATURE (30)..(31): Xaa = any amino acid, non amino acid, or is absent
XXHXXQPXAQEPXXXTAYKPXXFXPPAPXXX

SEQ ID NO: 37682 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (26)..(26): Xaa = Val or Ile
  MISC_FEATURE (30)..(31): Xaa = any amino acid, non amino acid, or is absent
XXHXXQPXAQEPXXXTAYKPXXDFTXFPPXX

SEQ ID NO: 37683 - protein, 31 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Tyr, Thr or His
  MISC_FEATURE (27)..(27): Xaa = His or Ile
  MISC_FEATURE (29)..(29): Xaa = Tyr or Ala
  MISC_FEATURE (30)..(31): Xaa = any amino acid, non amino acid, or is absent
XXHXXQPXAQEPXXXTAYKPXXXTPAXFXXX

SEQ ID NO: 37684 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Pro or Ala
  MISC_FEATURE (26)..(26): Xaa = Ala, Pro, Trp, Asn or Leu
  MISC_FEATURE (29)..(29): Xaa = Pro or Phe
  MISC_FEATURE (33)..(34): Xaa = any amino acid, non amino acid, or is absent
XXHXXQPXAQEPXXXTAYKPXXXARXTPXSPPXX

SEQ ID NO: 37685 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Trp or Leu
  MISC_FEATURE (24)..(24): Xaa = Ala, Asn, Ser, Trp or Glu
  MISC_FEATURE (30)..(30): Xaa = Ser or Phe
  MISC_FEATURE (31)..(32): Xaa = any amino acid, non amino acid, or is absent
XXHXXQPXAQEPXXXTAYKPXXXXTAYKPXXX

SEQ ID NO: 37686 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (23)..(23): Xaa = Asn, Trp or Ala
  MISC_FEATURE (25)..(25): Xaa = Phe, Asn, Tyr or Pro
  MISC_FEATURE (26)..(26): Xaa = Pro, His, Tyr, Trp or Ala
  MISC_FEATURE (29)..(29): Xaa = Tyr or Ala
  MISC_FEATURE (31)..(31): Xaa = Trp or Gln
  MISC_FEATURE (32)..(32): Xaa = Arg or Gln
  MISC_FEATURE (33)..(34): Xaa = any amino acid, non amino acid, or is absent
XXHXXQPXAQEPXXXTAYKPXXXAXXAPXIXXXX

SEQ ID NO: 37687 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Trp or Leu
  MISC_FEATURE (15)..(15): Xaa = Ala, Asn, Ser, Trp or Glu
  MISC_FEATURE (21)..(21): Xaa = Ser or Phe
  MISC_FEATURE (22)..(22): Xaa = any amino acid, non amino acid, or is absent
  MISC_FEATURE (24)..(24): Xaa = Glu, Gly, Trp or Phe
  MISC_FEATURE (25)..(25): Xaa = Gly, Ala or Asn
  MISC_FEATURE (28)..(28): Xaa = His, Trp or Lys
  MISC_FEATURE (33)..(34): Xaa = any amino acid, non amino acid, or is absent
XXHXXQPXAQEPXXXTAYKPXXHXXQPXAQEPXX

SEQ ID NO: 37688 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXHXXQPXAQEPXXAXXAPXIXXXXXGFXLKXXXX

SEQ ID NO: 37689 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXHXXQPXAQEPXXAXXAPXIXXXXXTPAXXXXXXX

SEQ ID NO: 37690 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXHXXQPXAQEPXXAXXAPXIXXXXXXAPWXX

SEQ ID NO: 37691 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXHXXQPXAQEPXXAXXAPXIXXXPPXXXXPXX

SEQ ID NO: 37692 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXHXXQPXAQEPXXAXXAPXIXXXXXXXXXXXX

SEQ ID NO: 37693 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXHXXQPXAQEPXXAXXAPXIXXXFXPPAPXXX

SEQ ID NO: 37694 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXHXXQPXAQEPXXAXXAPXIXXXDFTXFPPXX

SEQ ID NO: 37695 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXHXXQPXAQEPXXAXXAPXIXXXXTPAXFXXX

SEQ ID NO: 37696 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXHXXQPXAQEPXXAXXAPXIXXXXARXTPXSPPXX

SEQ ID NO: 37697 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXHXXQPXAQEPXXAXXAPXIXXXXXTAYKPXXX

SEQ ID NO: 37698 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXHXXQPXAQEPXXAXXAPXIXXXXAXXAPXIXXXX

SEQ ID NO: 37699 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (14)..(14): Xaa = Asn, Trp or Ala
  MISC_FEATURE (16)..(16): Xaa = Phe, Asn, Tyr or Pro
  MISC_FEATURE (17)..(17): Xaa = Pro, His, Tyr, Trp or Ala
  MISC_FEATURE (20)..(20): Xaa = Tyr or Ala
  MISC_FEATURE (22)..(22): Xaa = Trp or Gln
  MISC_FEATURE (23)..(23): Xaa = Arg or Gln
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXHXXQPXAQEPXXAXXAPXIXXXHXXQPXAQEPXX

SEQ ID NO: 37700 - protein, 35 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (29)..(29): Xaa = any amino acid, non amino acid, or is absent
  MISC_FEATURE (32)..(35): Xaa = any amino acid, non amino acid, or is absent
XXHXXQPXAQEPXHXXQPXAQEPXXXGFXLKXXXX

SEQ ID NO: 37701 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(26): Xaa = any amino acid, non amino acid, or is absent
  MISC_FEATURE (30)..(30): Xaa = Asn or Asp
  MISC_FEATURE (31)..(31): Xaa = Asn or Glu
  MISC_FEATURE (32)..(36): Xaa = any amino acid, non amino acid, or is absent
XXHXXQPXAQEPXHXXQPXAQEPXXXTPAXXXXXXX

SEQ ID NO: 37702 - protein, 32 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Ile, Phe, Trp, Tyr or Ala
  MISC_FEATURE (26)..(26): Xaa = Asp, Ala, Gln, Glu, Gly, His, Ile, Leu, Phe, Pro, Thr or Tyr
  MISC_FEATURE (27)..(27): Xaa = Gln, Leu, Trp or Tyr
  MISC_FEATURE (31)..(32): Xaa = any amino acid, non amino acid, or is absent
XXHXXQPXAQEPXHXXQPXAQEPXXXXAPWXX

SEQ ID NO: 37703 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (27)..(27): Xaa = Tyr or Pro
  MISC_FEATURE (28)..(28): Xaa = Trp, Tyr, Phe, Ala, Val, Cys, Thr, Leu, Ser, His, Gln, Glu, Gly or Ile
  MISC_FEATURE (29)..(29): Xaa = Trp, Ile, Phe, Pro, Asp, Gly, Cys or Ala
  MISC_FEATURE (30)..(30): Xaa = Gly or Asn
  MISC_FEATURE (32)..(33): Xaa = any amino acid, non amino acid, or is absent
XXHXXQPXAQEPXHXXQPXAQEPXPPXXXXPXX

SEQ ID NO: 37704 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Gly, Tyr or Trp
  MISC_FEATURE (26)..(26): Xaa = Trp, Val, Ile, Phe, Arg, Met, Ser or Leu
  MISC_FEATURE (27)..(27): Xaa = Ile or Gly
  MISC_FEATURE (28)..(28): Xaa = Tyr, Pro, His, Leu or Phe
  MISC_FEATURE (29)..(29): Xaa = Ile, Asp, Tyr, Phe, Val, Thr, Gly, Ala or Gln
  MISC_FEATURE (30)..(30): Xaa = Phe, Arg, Cys, Leu, Ala, Gln, Asp or Val
  MISC_FEATURE (31)..(31): Xaa = Phe or Tyr
  MISC_FEATURE (32)..(33): Xaa = any amino acid, non amino acid, or is absent
XXHXXQPXAQEPXHXXQPXAQEPXXXXXXXXXX

SEQ ID NO: 37705 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Pro or Ser
  MISC_FEATURE (31)..(31): Xaa = Pro, Tyr, Leu, Ala, Glu, Gly, Val or Ile
  MISC_FEATURE (32)..(33): Xaa = any amino acid, non amino acid, or is absent
XXHXXQPXAQEPXHXXQPXAQEPXFXPPAPXXX

SEQ ID NO: 37706 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (28)..(28): Xaa = Val or Ile
  MISC_FEATURE (32)..(33): Xaa = any amino acid, non amino acid, or is absent
XXHXXQPXAQEPXHXXQPXAQEPXDFTXFPPXX

SEQ ID NO: 37707 - protein, 33 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Tyr, Thr or His
  MISC_FEATURE (29)..(29): Xaa = His or Ile
  MISC_FEATURE (31)..(31): Xaa = Tyr or Ala
  MISC_FEATURE (32)..(33): Xaa = any amino acid, non amino acid, or is absent
XXHXXQPXAQEPXHXXQPXAQEPXXTPAXFXXX

SEQ ID NO: 37708 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Pro or Ala
  MISC_FEATURE (28)..(28): Xaa = Ala, Pro, Trp, Asn or Leu
  MISC_FEATURE (31)..(31): Xaa = Pro or Phe
  MISC_FEATURE (35)..(36): Xaa = any amino acid, non amino acid, or is absent
XXHXXQPXAQEPXHXXQPXAQEPXXARXTPXSPPXX

SEQ ID NO: 37709 - protein, 34 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Trp or Leu
  MISC_FEATURE (26)..(26): Xaa = Ala, Asn, Ser, Trp or Glu
  MISC_FEATURE (32)..(32): Xaa = Ser or Phe
  MISC_FEATURE (33)..(34): Xaa = any amino acid, non amino acid, or is absent
XXHXXQPXAQEPXHXXQPXAQEPXXXTAYKPXXX

SEQ ID NO: 37710 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (25)..(25): Xaa = Asn, Trp or Ala
  MISC_FEATURE (27)..(27): Xaa = Phe, Asn, Tyr or Pro
  MISC_FEATURE (28)..(28): Xaa = Pro, His, Tyr, Trp or Ala
  MISC_FEATURE (31)..(31): Xaa = Tyr or Ala
  MISC_FEATURE (33)..(33): Xaa = Trp or Gln
  MISC_FEATURE (34)..(34): Xaa = Arg or Gln
  MISC_FEATURE (35)..(36): Xaa = any amino acid, non amino acid, or is absent
XXHXXQPXAQEPXHXXQPXAQEPXXAXXAPXIXXXX

SEQ ID NO: 37711 - protein, 36 aa, Artificial Sequence
  Synthetic construct
  MISC_FEATURE (1)..(2): Xaa = any amino acid, non amino acid, or is absent
  MISC_FEATURE (4)..(4): Xaa = Glu, Gly, Trp or Phe
  MISC_FEATURE (5)..(5): Xaa = Gly, Ala or Asn
  MISC_FEATURE (8)..(8): Xaa = His, Trp or Lys
  MISC_FEATURE (13)..(13): Xaa = any amino acid, non amino acid, or is absent
  MISC_FEATURE (15)..(15): Xaa = Glu, Gly, Trp or Phe
  MISC_FEATURE (16)..(16): Xaa = Gly, Ala or Asn
  MISC_FEATURE (19)..(19): Xaa = His, Trp or Lys
  MISC_FEATURE (24)..(24): Xaa = any amino acid, non amino acid, or is absent
  MISC_FEATURE (26)..(26): Xaa = Glu, Gly, Trp or Phe
  MISC_FEATURE (27)..(27): Xaa = Gly, Ala or Asn
  MISC_FEATURE (30)..(30): Xaa = His, Trp or Lys
  MISC_FEATURE (35)..(36): Xaa = any amino acid, non amino acid, or is absent
XXHXXQPXAQEPXHXXQPXAQEPXHXXQPXAQEPXX

SEQ ID NO: 37712 - DNA, 30 bp, Artificial Sequence
  Synthetic primer
gggtaccatatgatcgtcaattccaaacgc

SEQ ID NO: 37713 - DNA, 33 bp, Artificial Sequence
  Synthetic primer
ccttggctcgagttaatcttcagacggttcctg

SEQ ID NO: 37714 - DNA, 30 bp, Artificial Sequence; identical to SEQ ID NO: 37712
  Synthetic primer

SEQ ID NO: 37715 - DNA, 30 bp, Artificial Sequence
  Synthetic primer
ccttggctcgagaatggggagctgggggcg

SEQ ID NO: 37716 - DNA, 30 bp, Artificial Sequence
  Synthetic primer
gggtaccatatgctggcggaatgcggcctg

SEQ ID NO: 37717 - DNA, 33 bp, Artificial Sequence; identical to SEQ ID NO: 37713
  Synthetic primer

SEQ ID NO: 37718 - protein, 8 aa, Artificial Sequence
  Synthetic construct
LETAYKPF

SEQ ID NO: 37719 - protein, 6 aa, Artificial Sequence
  Synthetic construct
FGFELK

SEQ ID NO: 37720 - protein, 6 aa, Artificial Sequence
  Synthetic construct
YGFELK

SEQ ID NO: 37721 - protein, 6 aa, Artificial Sequence
  Synthetic construct
WGFELK

SEQ ID NO: 37722 - protein, 6 aa, Artificial Sequence
  Synthetic construct
IGFELK

SEQ ID NO: 37723 - protein, 6 aa, Artificial Sequence
  Synthetic construct
LGFHLK

SEQ ID NO: 37724 - protein, 6 aa, Artificial Sequence
  Synthetic construct
LGFFLK

SEQ ID NO: 37725 - protein, 6 aa, Artificial Sequence
  Synthetic construct
LGFNLK

SEQ ID NO: 37726 - protein, 6 aa, Artificial Sequence
  Synthetic construct
LGFQLK

SEQ ID NO: 37727 - protein, 6 aa, Artificial Sequence
  Synthetic construct
LGFGLK

SEQ ID NO: 37728 - protein, 6 aa, Artificial Sequence
  Synthetic construct
LGFPLK

SEQ ID NO: 37729 - protein, 6 aa, Artificial Sequence
  Synthetic construct
LGFSLK

SEQ ID NO: 37730 - protein, 6 aa, Artificial Sequence
  Synthetic construct
LGFVLK

SEQ ID NO: 37731 - protein, 6 aa, Artificial Sequence
  Synthetic construct
LGFRLK

SEQ ID NO: 37732 - protein, 6 aa, Artificial Sequence
  Synthetic construct
LGFCLK

SEQ ID NO: 37733 - protein, 6 aa, Artificial Sequence
  Synthetic construct
LGFTLK

SEQ ID NO: 37734 - protein, 6 aa, Artificial Sequence
  Synthetic construct
LGFWLK

SEQ ID NO: 37735 - protein, 6 aa, Artificial Sequence
  Synthetic construct
LGFYLK

SEQ ID NO: 37736 - protein, 6 aa, Artificial Sequence
  Synthetic construct
LGFYLK

SEQ ID NO: 37737 - protein, 43 aa, Artificial Sequence
  Synthetic construct
  MISC_FEATURE (1)..(2): Xaa = any amino acid, or is absent
  MISC_FEATURE (5)..(5): Xaa = any amino acid, or is absent
  MISC_FEATURE (15)..(15): Xaa = Lys or Arg
  MISC_FEATURE (18)..(18): Xaa = Glu or Asp
  MISC_FEATURE (29)..(29): Xaa = Lys or Arg
  MISC_FEATURE (39)..(39): Xaa = Asn or Asp
  MISC_FEATURE (40)..(40): Xaa = Asn or Glu
  MISC_FEATURE (41)..(43): Xaa = any amino acid, or is absent
XXGFXLKAINSLVNXLAXCGLSKFIKVYXPQLPIETPAXXXXX
